United States Patent 7,745,391 (HUMAN THROMBOSPONDIN POLYPEPTIDE) - sequence listing, part 116

SEQ ID NO: 334059 - DNA, 525 bp, Homo sapiens
ctgctccccagcaagacacacacatacttaatagcccctcacttcccacagatgggggaatatgaaaatattccaaaaggcccctgtggtaacttctgagcagtcacatttgtcccattacaagagtgtttttaagaaaactagggggggaggagtgcaaattcctaccaacccacattgattcgcccttgcaaagaagtttctgctccttcaacccactgcgtagtggtttctgcctacaacagtaaggtgacaaccctgactagacttccaatggcgactccaggaccaaaactcgtgtgagaaaagatccaggcaagcttctgttgttctgaaatgctagcagaggcaggaaggagtcaacaggcgaggaggctgccttctgcccagcttctcagagttagataagtcatattcctgaaaatctaatttaaatgattcccagatttttcttcacaatctatcacgcaagtccctcaactgtctttcggggagcaagtccctcaactgtctttgctggggatg

SEQ ID NO: 334060 - DNA, 946 bp, Homo sapiens
agccagccaaatgtgtttcagatcctaaatcctccacctaaggggagttgctgagtcagcccagaccggaaggagtggcagagatcatttgccccaagaacggcagcgagcgagtaaatgttgccttggtttacccacccacgccgactgtgatcagcccctgttccaagtatcttcatactttcttggaaaattaagtggaaaagatagtgcttcttttccttatgccatcatttttactgtacccaaactgtgactttaggagcaccaatttttaagggaagaatgttggtgaaaagcacagaaaccagtgacgtttgtggctgtggaatttccatggagaaaagagagcatctgaacacctggaccatcttttgcacctggcagaccctctgcactcaccccagcgtgttctgtgaacttgagtgacaacgcgtgcttgcagggtgctttttggatgactggggaagaggtggggagggggtggtggggggaagcatggacgagaacatggagcaaatgttttacaacctgaacctcagaactgtgatcctccaaggagcgcgctacttgaagaaaagaaaaaaaaaaaaaaaagtcgaatggcttctcagggattttgttttccgtgcacatataagccatagttacagtacaggtggcagtatttagagcactcagatttcagttctgttaaatgtgaaagagggatcgactgacgttcattgctgttccataactagtgtaaaatatgtatatgtttatctttatttttataatatgcaaatacatttaaatttatacagtttgaagcttctagcgttagttcacactgggtgcaatattctgcatgagaactgtgccaagatggggctgatttcttattttagtataagacttttttgttttttctttattctttaatcctcttcacattaaaaaaaaa

SEQ ID NO: 334061 - DNA, 838 bp, Homo sapiens
ccacagttaatcagtgatttcctcagatgtccacatgctcctacggggagttgctgagtcagcccagaccggaaggagtggcagagatcatttgccccaagaacggcagcgagcgagtaaatgttgccttggtttacccacccacgccgactgtgatcagcccctgttccaagaagaatgttggtgaaaagcacagaaaccagtgacgtttgtggctgtggaatttccatggagaaaagagagcatctgaacacctggaccatcttttgcacctggcagaccctctgcactcaccccagcgtgttctgtgaacttgagtgacaacgcgtgcttgcagggtgctttttggatgactggggaagaggtggggagggggtggtggggggaagcatggacgagaacatggagcaaatgttttacaacctgaacctcagaactgtgatcctccaaggagcgcgctacttgaagaaaagaaaaaaaaaaaaaaaagtcgaatggcttctcagggattttgttttccgtgcacatataagccatagttacagtacaggtggcagtatttagagcactcagatttcagttctgttaaatgtgaaagagggatcgactgacgttcattgctgttccataactagtgtaaaatatgtatatgtttatctttatttttataatatgcaaatacatttaaatttatacagtttgaagcttctagcgttagttcacactgggtgcaatattctgcatgagaactgtgccaagatggggctgatttcttattttagtataagacttttttgttttttctttattctttaatcctcttcacattaaaaaaaaa

SEQ ID NO: 334062 - DNA, 823 bp, Homo sapiens
aggcattaatttcactgactccagaacctgcagttcagagaatgatttcttatgatgataaaaatcgaatgggatcagacgatgtttgcatttttttaatacttgaataggacacctcaagtttgagatttcattttcttttagaacacagtcacaagaagaatgttggtgaaaagcacagaaaccagtgacgtttgtggctgtggaatttccatggagaaaagagagcatctgaacacctggaccatcttttgcacctggcagaccctctgcactcaccccagcgtgttctgtgaacttgagtgacaacgcgtgcttgcagggtgctttttggatgactggggaagaggtggggagggggtggtggggggaagcatggacgagaacatggagcaaatgttttacaacctgaacctcagaactgtgatcctccaaggagcgcgctacttgaagaaaagaaaaaaaaaaaaaaaagtcgaatggcttctcagggattttgttttccgtgcacatataagccatagttacagtacaggtggcagtatttagagcactcagatttcagttctgttaaatgtgaaagagggatcgactgacgttcattgctgttccataactagtgtaaaatatgtatatgtttatctttatttttataatatgcaaatacatttaaatttatacagtttgaagcttctagcgttagttcacactgggtgcaatattctgcatgagaactgtgccaagatggggctgatttcttattttagtataagacttttttgttttttctttattctttaatcctcttcacattaaaaaaaaa

SEQ ID NO: 334063 - DNA, 3409 bp, Homo sapiens
  misc_feature (3354)..(3354): n is a, c, g, or t
cggccgccggccgccgagcgcgggagggcaggcaggggcaggagccggagggcccggggcgcggcgcggcatgtagctgcgggctcccgcgtccgcgtgaggctgtcggcccggggccccgccatggctgggatggacagtggcaacctgaagaccgcgaggctgtggcgggacgccgccctgcgtgccaggaagctgcggagcaacctgcgccagctcacgcttaccgccgccggggcctgccccggggccggggccgacgcgctcgagtcccccgcctccccccagctcgtgctgccggccaacctcggggacattgaggcactgaacctggggaacaacggcctggaggaggtacccgaggggctggggtcggcgctgggcagcctgcgcgtcctggtcctgcgcaggaaccgcttcgcccggctgcccccggcggtggccgagctcggccaccacctcaccgagctggacgtgagccacaaccggctgaccgccctgggcgcggaggtggtgagtgctctgagggagctgcggaagctcaacctcagccacaaccagctgcccgccctgcccgcccagctgggcgctctcgctcacctggaggagctggatgtcagctttaaccggctggcgcacctgcctgactccctctcctgcctctcccgcctgcgcaccctggacgtggatcacaaccagctcactgccttcccccggcagctgctgcagctggtggccctggaggagctggacgtgtccagcaaccggctgcggggcctgcctgaggatatcagtgccctgcgtgccctcaagatcctctggctgagtggggccgagcttggcacgctgcccgccggcttctgcgagctggccagtttggagagcctcatgctagacaacaacgggctgcaggctctgcccgcccagttcagctgcctgcagcggctcaaaatgctcaacctgtcctccaacctcttcgaggagttccctgccgcgctgctgcccctggctggtctggaggagctctaccttagtcgcaaccagctcacctcggtgccatcccttatctcgggcctgggccggcttctcaccttgtggctggataataaccgcatccgctacctgccggactccatcgtggagctgaccggcctggaggagctcgtgctgcaggggaaccagatcgcggtgctgcccgaccactttggccagctctcccgggtgggtttgtggaagatcaaagacaacccactgatccagcccccctacgaggtctgcatgaaggggatcccctacatcgcagcctaccagaaggaactggctcattcccagccggcggtgcagccccggctcaagctgctcctgatggggcataaggctgcaggaaagactttgctgcgccactgcctcaccgaggagagagtggagggatgcccaggaggaggggacaaggagaagtgctacccaccgtcacctccccctgtgagcaagggcatcgaggtgaccagctggacggccgatgcctcccggggcctgcggttcatcgtgtatgacttagctggggatgaaagttatgaggtgatccagcccttcttcctgtccccaggggccctatacgtgctggtggtcaacttggccacctatgagcctcgccactttcctaccaccgtgggctccttcttgcatcgggtcggggcgagagtgccccacgcggtggtgtgcatcgtgggcacccacgcagacctgtgcggagagcgtgagctggaggagaaatgtctggacattcaccgccagatcgccctgcaggagaagcacgacgcggagggactgagccgcttggccaaggtggtggacgaggcactggcccgggacttcgagctgcgctctgccagcccccacgcagcctactatggcgtttcggacaagaaccttcgacggcgcaaggcccattttcaatacctgctcaaccaccggctgcagatcctctcccccgtgttgcctgttagctgcagggacccgcgccacttacgacgccttcgggacaagttgctgtcagttgctgagcaccgagagatcttccccaacttacacagagtactgcctcgatcctggcaggtgctggaggaactgcatttccagccacctcaggcccagcgactgtggctaagctggtgggactcggcgcgcttgggcctgcaggcgggtctgaccgaggaccgactgcagagtgccctctcctacctgcatgagagcggcaagctactctactttgaggacagtccggctctcaaggagcacgtcttccacaacctcacccgcctcatcgacatcctcaatgtcttcttccagagggatccctctttgctgctgcataagctgctcctagggaccagtggagagggcaaggcggagggggaaagctccccgcccatggcgcggtccacccccagccaggaactgctccgggccacccagctccatcagtatgtggagggctttctgttgcatgggctcttgccagctcatgtcattcggttgctgcttaagcctcatgtccaggcccagcaggacttgcagctgttgctggagctgctggagaagatgggactctgttactgcctcaataaacccaagggcaagcctttgaatgggtccacagcttggtacaagttcccatgctatgtgcagaacgaggtgccccatgcagaagcctggattaatgggaccaacctagctgggcagtcttttgtggctgagcagttgcagattgaatatagctttccttttacttttccacctgggttgtttgcacgctacagtgtccagatcaacagccatgtggtgcacaggtcggatggtaaatttcagatctttgcctatagagggaaagttcctgtggttgtgagttacagacctgccaggggagtcctgcagccagacaccctgtccattgctagccatgcatcattaccaaatatatggaccgcatggcaagccataacccccttggtggaggaactgaatgtcctacttcaggaatggcctggactgcactacaccgtgcacattctctgttctaagtgccttaagagaggatcgcccaatccacatgcttttccaggggagttgctgagtcagcccagaccggaaggagtggcagagatcatttgccccaagaacggcagcgagcgagtaaatgttgccttggtttacccacccacgccgactgtgatcagcccctgttccaatacccgattacaagaagaatcagggtacagagacgagcatgcagtcacatttgtgcctggtgcatccttatggagcaaagagggtatcaagaggcagcagtccagntaggagacactagtaccgcagagctgaggagcgtggggtcttggcgctcaaggat

SEQ ID NO: 334064 - DNA, 3914 bp, Homo sapiens
cggccgccggccgccgagcgcgggagggcaggcaggggcaggagccggagggcccggggcgcggcgcggcatgtagctgcgggctcccgcgtccgcgtgaggctgtcggcccggggccccgccatggctgggatggacagtggcaacctgaagaccgcgaggctgtggcgggacgccgccctgcgtgccaggaagctgcggagcaacctgcgccagctcacgcttaccgccgccggggcctgccccggggccggggccgacgcgctcgagtcccccgcctccccccagctcgtgctgccggccaacctcggggacattgaggcactgaacctggggaacaacggcctggaggaggtacccgaggggctggggtcggcgctgggcagcctgcgcgtcctggtcctgcgcaggaaccgcttcgcccggctgcccccggcggtggccgagctcggccaccacctcaccgagctggacgtgagccacaaccggctgaccgccctgggcgcggaggtggtgagtgctctgagggagctgcggaagctcaacctcagccacaaccagctgcccgccctgcccgcccagctgggcgctctcgctcacctggaggagctggatgtcagctttaaccggctggcgcacctgcctgactccctctcctgcctctcccgcctgcgcaccctggacgtggatcacaaccagctcactgccttcccccggcagctgctgcagctggtggccctggaggagctggacgtgtccagcaaccggctgcggggcctgcctgaggatatcagtgccctgcgtgccctcaagatcctctggctgagtggggccgagcttggcacgctgcccgccggcttctgcgagctggccagtttggagagcctcatgctagacaacaacgggctgcaggctctgcccgcccagttcagctgcctgcagcggctcaaaatgctcaacctgtcctccaacctcttcgaggagttccctgccgcgctgctgcccctggctggtctggaggagctctaccttagtcgcaaccagctcacctcggtgccatcccttatctcgggcctgggccggcttctcaccttgtggctggataataaccgcatccgctacctgccggactccatcgtggagctgaccggcctggaggagctcgtgctgcaggggaaccagatcgcggtgctgcccgaccactttggccagctctcccgggtgggtttgtggaagatcaaagacaacccactgatccagcccccctacgaggtctgcatgaaggggatcccctacatcgcagcctaccagaaggaactggctcattcccagccggcggtgcagccccggctcaagctgctcctgatggggcataaggctgcaggaaagactttgctgcgccactgcctcaccgaggagagagtggagggatgcccaggaggaggggacaaggagaagtgctacccaccgtcacctccccctgtgagcaagggcatcgaggtgaccagctggacggccgatgcctcccggggcctgcggttcatcgtgtatgacttagctggggatgaaagttatgaggtgatccagcccttcttcctgtccccaggggccctatacgtgctggtggtcaacttggccacctatgagcctcgccactttcctaccaccgtgggctccttcttgcatcgggtcggggcgagagtgccccacgcggtggtgtgcatcgtgggcacccacgcagacctgtgcggagagcgtgagctggaggagaaatgtctggacattcaccgccagatcgccctgcaggagaagcacgacgcggagggactgagccgcttggccaaggtggtggacgaggcactggcccgggacttcgagctgcgctctgccagcccccacgcagcctactatggcgtttcggacaagaaccttcgacggcgcaaggcccattttcaatacctgctcaaccaccggctgcagatcctctcccccgtgttgcctgttagctgcagggacccgcgccacttacgacgccttcgggacaagttgctgtcagttgctgagcaccgagagatcttccccaacttacacagagtactgcctcgatcctggcaggtgctggaggaactgcatttccagccacctcaggcccagcgactgtggctaagctggtgggactcggcgcgcttgggcctgcaggcgggtctgaccgaggaccgactgcagagtgccctctcctacctgcatgagagcggcaagctactctactttgaggacagtccggctctcaaggagcacgtcttccacaacctcacccgcctcatcgacatcctcaatgtcttcttccagagggatccctctttgctgctgcataagctgctcctagggaccagtggagagggcaaggcggagggggaaagctccccgcccatggcgcggtccacccccagccaggaactgctccgggccacccagctccatcagtatgtggagggctttctgttgcatgggctcttgccagctcatgtcattcggttgctgcttaagcctcatgtccaggcccagcaggacttgcagctgttgctggagctgctggagaagatgggactctgttactgcctcaataaacccaagggcaagcctttgaatgggtccacagcttggtacaagttcccatgctatgtgcagaacgaggtgccccatgcagaagcctggattaatgggaccaacctagctgggcagtcttttgtggctgagcagttgcagattgaatatagctttccttttacttttccacctgggttgtttgcacgctacagtgtccagatcaacagccatgtggtgcacaggtcggatggtaaatttcagatctttgcctatagagggaaagttcctgtggttgtgagttacagacctgccaggggagtcctgcagccagacaccctgtccattgctagccatgcatcattaccaaatatatggaccgcatggcaagccataacccccttggtggaggaactgaatgtcctacttcaggaatggcctggactgcactacaccgtgcacattctctgttctaagtgccttaagagaggatcgcccaatccacatgcttttccaggggagttgctgagtcagcccagaccggaaggagtggcagagatcatttgccccaagaacggcagcgagcgagtaaatgttgccttggtttacccacccacgccgactgtgatcagcccctgttccaagaagaatgttggtgaaaagcacagaaaccagtgacgtttgtggctgtggaatttccatggagaaaagagagcatctgaacacctggaccatcttttgcacctggcagaccctctgcactcaccccagcgtgttctgtgaacttgagtgacaacgcgtgcttgcagggtgctttttggatgactggggaagaggtggggagggggtggtggggggaagcatggacgagaacatggagcaaatgttttacaacctgaacctcagaactgtgatcctccaaggagcgcgctacttgaagaaaagaaaaaaaaaaaaaaaagtcgaatggcttctcagggattttgttttccgtgcacatataagccatagttacagtacaggtggcagtatttagagcactcagatttcagttctgttaaatgtgaaagagggatcgactgacgttcattgctgttccataactagtgtaaaatatgtatatgtttatctttatttttataatatgcaaatacatttaaatttatacagtttgaagcttctagcgttagttcacactgggtgcaatattctgcatgagaactgtgccaagatggggctgatttcttattttagtataagacttttttgttttttctttattctttaatcctcttcacattaaaaaaaaa

SEQ ID NO: 334065 - DNA, 4025 bp, Homo sapiens
cggccgccggccgccgagcgcgggagggcaggcaggggcaggagccggagggcccggggcgcggcgcggcatgtagctgcgggctcccgcgtccgcgtgaggctgtcggcccggggccccgccatggctgggatggacagtggcaacctgaagaccgcgaggctgtggcgggacgccgccctgcgtgccaggaagctgcggagcaacctgcgccagctcacgcttaccgccgccggggcctgccccggggccggggccgacgcgctcgagtcccccgcctccccccagctcgtgctgccggccaacctcggggacattgaggcactgaacctggggaacaacggcctggaggaggtacccgaggggctggggtcggcgctgggcagcctgcgcgtcctggtcctgcgcaggaaccgcttcgcccggctgcccccggcggtggccgagctcggccaccacctcaccgagctggacgtgagccacaaccggctgaccgccctgggcgcggaggtggtgagtgctctgagggagctgcggaagctcaacctcagccacaaccagctgcccgccctgcccgcccagctgggcgctctcgctcacctggaggagctggatgtcagctttaaccggctggcgcacctgcctgactccctctcctgcctctcccgcctgcgcaccctggacgtggatcacaaccagctcactgccttcccccggcagctgctgcagctggtggccctggaggagctggacgtgtccagcaaccggctgcggggcctgcctgaggatatcagtgccctgcgtgccctcaagatcctctggctgagtggggccgagcttggcacgctgcccgccggcttctgcgagctggccagtttggagagcctcatgctagacaacaacgggctgcaggctctgcccgcccagttcagctgcctgcagcggctcaaaatgctcaacctgtcctccaacctcttcgaggagttccctgccgcgctgctgcccctggctggtctggaggagctctaccttagtcgcaaccagctcacctcggtgccatcccttatctcgggcctgggccggcttctcaccttgtggctggataataaccgcatccgctacctgccggactccatcgtggagctgaccggcctggaggagctcgtgctgcaggggaaccagatcgcggtgctgcccgaccactttggccagctctcccgggtgggtttgtggaagatcaaagacaacccactgatccagcccccctacgaggtctgcatgaaggggatcccctacatcgcagcctaccagaaggaactggctcattcccagccggcggtgcagccccggctcaagctgctcctgatggggcataaggctgcaggaaagactttgctgcgccactgcctcaccgaggagagagtggagggatgcccaggaggaggggacaaggagaagtgctacccaccgtcacctccccctgtgagcaagggcatcgaggtgaccagctggacggccgatgcctcccggggcctgcggttcatcgtgtatgacttagctggggatgaaagttatgaggtgatccagcccttcttcctgtccccaggggccctatacgtgctggtggtcaacttggccacctatgagcctcgccactttcctaccaccgtgggctccttcttgcatcgggtcggggcgagagtgccccacgcggtggtgtgcatcgtgggcacccacgcagacctgtgcggagagcgtgagctggaggagaaatgtctggacattcaccgccagatcgccctgcaggagaagcacgacgcggagggactgagccgcttggccaaggtggtggacgaggcactggcccgggacttcgagctgcgctctgccagcccccacgcagcctactatggcgtttcggacaagaaccttcgacggcgcaaggcccattttcaatacctgctcaaccaccggctgcagatcctctcccccgtgttgcctgttagctgcagggacccgcgccacttacgacgccttcgggacaagttgctgtcagttgctgagcaccgagagatcttccccaacttacacagagtactgcctcgatcctggcaggtgctggaggaactgcatttccagccacctcaggcccagcgactgtggctaagctggtgggactcggcgcgcttgggcctgcaggcgggtctgaccgaggaccgactgcagagtgccctctcctacctgcatgagagcggcaagctactctactttgaggacagtccggctctcaaggagcacgtcttccacaacctcacccgcctcatcgacatcctcaatgtcttcttccagagggatccctctttgctgctgcataagctgctcctagggaccagtggagagggcaaggcggagggggaaagctccccgcccatggcgcggtccacccccagccaggaactgctccgggccacccagctccatcagtatgtggagggctttctgttgcatgggctcttgccagctcatgtcattcggttgctgcttaagcctcatgtccaggcccagcaggacttgcagctgttgctggagctgctggagaagatgggactctgttactgcctcaataaacccaagggcaagcctttgaatgggtccacagcttggtacaagttcccatgctatgtgcagaacgaggtgccccatgcagaagcctggattaatgggaccaacctagctgggcagtcttttgtggctgagcagttgcagattgaatatagctttccttttacttttccacctgggttgtttgcacgctacagtgtccagatcaacagccatgtggtgcacaggtcggatggtaaatttcagatctttgcctatagagggaaagttcctgtggttgtgagttacagacctgccaggggagtcctgcagccagacaccctgtccattgctagccatgcatcattaccaaatatatggaccgcatggcaagccataacccccttggtggaggaactgaatgtcctacttcaggaatggcctggactgcactacaccgtgcacattctctgttctaagtgccttaagagaggatcgcccaatccacatgcttttccaggggagttgctgagtcagcccagaccggaaggagtggcagagatcatttgccccaagaacggcagcgagcgagtaaatgttgccttggtttacccacccacgccgactgtgatcagcccctgttccaagtatcttcatactttcttggaaaattaagtggaaaagatagtgcttcttttccttatgccatcatttttactgtacccaaactgtgactttaggagcaccaatttttaagggaagaatgttggtgaaaagcacagaaaccagtgacgtttgtggctgtggaatttccatggagaaaagagagcatctgaacacctggaccatcttttgcacctggcagaccctctgcactcaccccagcgtgttctgtgaacttgagtgacaacgcgtgcttgcagggtgctttttggatgactggggaagaggtggggagggggtggtggggggaagcatggacgagaacatggagcaaatgttttacaacctgaacctcagaactgtgatcctccaaggagcgcgctacttgaagaaaagaaaaaaaaaaaaaaaagtcgaatggcttctcagggattttgttttccgtgcacatataagccatagttacagtacaggtggcagtatttagagcactcagatttcagttctgttaaatgtgaaagagggatcgactgacgttcattgctgttccataactagtgtaaaatatgtatatgtttatctttatttttataatatgcaaatacatttaaatttatacagtttgaagcttctagcgttagttcacactgggtgcaatattctgcatgagaactgtgccaagatggggctgatttcttattttagtataagacttttttgttttttctttattctttaatcctcttcacattaaaaaaaaa

SEQ ID NO: 334066 - DNA, 270 bp, Homo sapiens
aaacatatgcacctgtgtggccaccaccacaatgtcaaaatacacatttccattcttccagaaagttcactgatacccctttccagtcagtccccctctctttttttggcaatcactgttctgatttcttagatttgcctgttatagaatgtcatgtaaatggaatcacacagtttatgttcttttgtctggcttcttttgctcaacataaactttttgagattcttcatgttgctgtttttatcagcaatttgttccttttattgctgt

SEQ ID NO: 334067 - DNA, 447 bp, Homo sapiens
gcaatgagctgtgattatgtcactgcacttcagcctgagtgacagaatgagaccttatctcaaaaaaaaggggtggggggaatagtaattgagagaattagtgatctgaacgatgactcagaagaggctctagaataaaacatgaaaaagacaatacaggagagtgttaagagacataatatagttaaaaggtctattgtgtcttattaaagtctcaaagaagagggacattggggtataaactgtatttaaagatattggctgagaattttccaaaagtgataaaatcagactttagaattaagaagcctaatgaataccaagtaggattgagaaaaagaaacctacccttaggcatgtcatagtgaaactctagaaataaagacaaagtctcaaaagcaaccgggagaaaacatttcagcttcaaaggagcaaaaatatctgacc

SEQ ID NO: 334068 - DNA, 297 bp, Homo sapiens
aaaagagcagctctaaagagggaccagtaaaaaaaagtattctcagtatttgtgagcagggaagtacttgcagcaaatgttgtctaggctggcatctgccaggaaatcataccccaaaaatgctaggaaacaaaactgtgcccaaggcagcaatctgaggtatgtgtatgtggatttatgcaaagttgaaattgattagggggagtttttaatcctcaccagagaggaaaaagaatttggagactcagttgcctaatgcagggtcctgtcatctttccagacagtgtgcctgagacg

SEQ ID NO: 334069 - DNA, 508 bp, Homo sapiens
ggcttttactcagacaggaaggcagcgtgagacctacacaactcaggcaccatcgtctgcagcaacccatactaagagttttggtgggccagggtctacgcaagcacttccccagagggccttggaagcctccctgggagccatatttcccacggttgggtcactcagaaataaaatcaaatgtggccaggtgcagtggctcacgcctataatcccagcactttgggaggccaagacggacggatcacgaggtcaagagatagagaccatcctggccaacacggtgaaaccccatctctactaaaaatacaaaaattagccgggcgtggtggcgtgcacctgtagtcccaactactcaggaggctgaggcagaagaatcgcttgaacccaggaggcggaggttgcagtaagcagagatcgaaccactgcactccagcctggcaacagagcgagactccatctcaaaaaaaaagggacaaatgtgactcttcctggaacagctagtact

SEQ ID NO: 334070 - DNA, 323 bp, Homo sapiens
gcctgcctcatgaattctgtctctttcactaatgtgtgtgctgaatgagatggtaataataacagctaataattattgagtatgtgtagtatgataagctctatgctaagtatttaatcccaactgtattgttatactcattttacagatgagaaaactgagtatttgccccatgttgtacagttagtaagtggtgaagtcaggacttgaatctaggaagactctctgactctagagcctacacgtgcatgcttatcctctctaccacctgaaatcactgacacgcagcgaccctgccccagagtgactgtactgcaaagaag

SEQ ID NO: 334071 - DNA, 5511 bp, Homo sapiens
tttttttacactttaaatgtgtggtttattgtatgccagttataacgcaatatagctgttaaacacaaacacaataaagttgaaaaaccagcaggcattccctgattaatcagtattctggggaggtaaggggctcacaggaacgcaaaagaaattcaggctgtaaatccagttggacgccccgctgccccatcccctccatccgggaccgcccgactcctctcccacctccttccccaggcctcccccaggcctccagtccggaagatgcgacgaggttagcggggcccgaccactccttggcttcccaggggtgagcctcgcgagttaggagttgggtagagagtcagcccggggcccggcatccgctttttcgttgaagcaacgactttggccggatgactccccagggtcggcatcagcgtgggactgggaacaggtgaagggaaacagaagagagcctgagaagaccgctctcctccgatcctaattgactgagccaatgagagccaaagaggtcacatgctcaactgggcggggagcgggtttccacctgcggcatctttcgcgagcggggagatgagtggggcggaatatgggagaaagggagggcccgccacgctctggctggacacggccttaatcggcccgttcactcgacgtttttggttctacgttgaccccgagaaaccgaaaccgcagggcctagggcgggtggaacgagagggaactacatttcccagcaggctgcggaaacgggactgcggccactacttccggcgtgtaccgagagactggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggctatacctccctttgaatttgctttcaaagatgagcgtatctcttttactattctggatgctgttatcagtccacctacagttccaaaagggaccatctgcaaagaggccaatgtttatccagcagaatgccggggccgaaggagtacctaccgtgggaagttgacagctgatatcaactgggcagtgaatggaatctcaaaaggaatcattaagcagtttcttggctatgttcccatcatggtgaaatccaagctttgcaacttacgtaaccttcccccacaagccctcattgagcaccatgaggaggcagaggaaatggggggctattttataatcaatggcattgaaaaagtcatccgaatgttgattatgcctcggagaaattttcccattgcaatgataagaccaaaatggaaaaccagagggcctggttatactcagtatggagtttcaatgcactgtgtgagggaagaacattccgctgtcaatatgaacctccactacttggaaaatggcacagttatgttgaactttatttaccgaaaagaactgttctttcttcctttgggatttgcacttaaggcacttgtcagcttttctgattatcagatctttcaggagctcatcaaaggaaaagaggatgattctttccttaggaactctgtttctcagatgttaaggattgtaatggaagagggttgtttgacacaaaaacaggtccttaactacctaggtgaatgcttcagagtaaaactcaatgttcctgactggtacccaaatgagcaagctgcggagttcctgtttaaccagtgcatctgtatccacttgaaatccaatactgaaaagttttatatgctttgtctcatgacgcgaaagctctttgctttagccaaaggagagtgcatggaggacaatcctgatagtttggtgaaccaggaagtcctcacaccgggtcagctcttccttatgttcctgaaggaaaaactggaaggttggttagtgtctattaaaatagcttttgataagaaggctcagaagaccagtgtttccatgaacactgacaatttgatgaggatttttacaatgggcatagaccttacaaaaccatttgaatacctttttgctactgggaatctgcgttctaaaacaggtcttggcctcctacaagattctggactttgtgttgtggctgacaagctgaacttcatacgctacctctcccatttccgctgcgtgcacagaggggctgattttgccaagatgaggaccaccacagtacgcaggctgctgccagagtcctggggcttcctttgtcccgtgcataccccagacggggagccctgtggcctgatgaaccacctaactgccgtatgtgaggttgtcacacagtttgtgtatacggcatctattccagctttactgtgcaacttgggggtcactcccattgatggagctccccaccgatcatacagtgagtgctaccctgtcctgctggacggtgtcatggttggctgggtggataaggatcttgctccaggcatcgcagattctcttcgtcattttaaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataatgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttacatatttaatgaatacaatttgatgggtctgactatatgcacacacctttgataccatcaccacaatcagggtaataaacatacctgtcatctccacaagtttcctcctgcccctttgttttttgctttttggttgctgttgagtttttgttttgtcttctgtggtaagaacacttaactcaagacctaccctcttaacaaatctttaagtgcacgatatagtattgttaattccaggcaccatgttgtacaacagatctttagaccttacttgtcttgcataactgaagctttatacctgttgaacaactctccatttccctggcccctagcaaccacccttctaccctgtttctatgagtttgactattacagatatctcatatagtgggatcatgcaatatttgtcctgtgactggcttatttcacttagcatagtgaaataagattcatccattttggaagccaggcatggtgctgtgcatctatagtccctgctatttgagaggctgaggtgggaggatcatttgagtgcaggagttcaaggacagcctgggtaatataggaagaccctgtcttgaagaccctgacctcaagtgatccacccacctcggcctccgaaagtgctaggattacaggtgtgagccactgtgcctggcctccggtgagtattttatatttagtctacacttccatacttggcttttttctgcttttatattgatctgctttcatagcagtgtgtagagtgccacttatgttttctttcttgtgtacagtattttattgtatggatttaccatcccctgtgtatttaagttgttccattctttggccattataacttttttctgcaaatattctggtgacttatctttggccattataaactgttgataatagatcatcttgtatatacttctgcaattataagatgttttttgatgaaagctttcctaaggtaattctttcctgagtttggttcagatggtctgtcactaattataaggcagataggaacagacagaaaaatctatcatttcaagataggcttagcaggatgggcgcagtggctcacgccactaatcccaacattttaggaggcctaggcaggagcaatcacttgtgcctgggagttctagactagcctgggcgagacttcatctctacaaaaaaagcaacaacgacaaaaaaaattagccaagcatagtggcacacccctgtagtcccagctacttgggaggctgaggtgggaggattgcttgaacccaagaggtcgaggctgcagtgagccaagattgtgccactgcactccagcctgggtgacagagcaggaccctgtctctattttataaattaaaaaaggctgggtgtggtggctcacacccataatcccaacactttggctcagcagattgcttgaacccaggaattcaagtccaatctgggcaacatggggaaaccccagctctacaaaaaaaattagcctggtgtggtggcacatgcctgtagttccagctactcaggaggctgaggtgggagaatctcctgagcctggaaggtccaggcagtgagccaagattgtgccaccacactccagcctgggcgacagaatgagaccctgtctcaaaaaaaaaaaaaaaaaaaaag

SEQ ID NO: 334072 - DNA, 5625 bp, Homo sapiens
tttttttacactttaaatgtgtggtttattgtatgccagttataacgcaatatagctgttaaacacaaacacaataaagttgaaaaaccagcaggcattccctgattaatcagtattctggggaggtaaggggctcacaggaacgcaaaagaaattcaggctgtaaatccagttggacgccccgctgccccatcccctccatccgggaccgcccgactcctctcccacctccttccccaggcctcccccaggcctccagtccggaagatgcgacgaggttagcggggcccgaccactccttggcttcccaggggtgagcctcgcgagttaggagttgggtagagagtcagcccggggcccggcatccgctttttcgttgaagcaacgactttggccggatgactccccagggtcggcatcagcgtgggactgggaacaggtgaagggaaacagaagagagcctgagaagaccgctctcctccgatcctaattgactgagccaatgagagccaaagaggtcacatgctcaactgggcggggagcgggtttccacctgcggcatctttcgcgagcggggagatgagtggggcggaatatgggagaaagggagggcccgccacgctctggctggacacggccttaatcggcccgttcactcgacgtttttggttctacgttgaccccgagaaaccgaaaccgcagggcctagggcgggtggaacgagagggaactacatttcccagcaggctgcggaaacgggactgcggccactacttccggcgtgtaccgagagactggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggctatacctccctttgaatttgctttcaaagatgagcgtatctcttttactattctggatgctgttatcagtccacctacagttccaaaagggaccatctgcaaagaggccaatgtttatccagcagaatgccggggccgaaggagtacctaccgtgggaagttgacagctgatatcaactgggcagtgaatggaatctcaaaaggaatcattaagcagtttcttggctatgttcccatcatggtgaaatccaagctttgcaacttacgtaaccttcccccacaagccctcattgagcaccatgaggaggcagaggaaatggggggctattttataatcaatggcattgaaaaagtcatccgaatgttgattatgcctcggagaaattttcccattgcaatgataagaccaaaatggaaaaccagagggcctggttatactcagtatggagtttcaatgcactgtgtgagggaagaacattccgctgtcaatatgaacctccactacttggaaaatggcacagttatgttgaactttatttaccgaaaagaactgttctttcttcctttgggatttgcacttaaggcacttgtcagcttttctgattatcagatctttcaggagctcatcaaaggaaaagaggatgattctttccttaggaactctgtttctcagatgttaaggattgtaatggaagagggttgtttgacacaaaaacaggtccttaactacctaggtgaatgcttcagagtaaaactcaatgttcctgactggtacccaaatgagcaagctgcggagttcctgtttaaccagtgcatctgtatccacttgaaatccaatactgaaaagttttatatgctttgtctcatgacgcgaaagctctttgctttagccaaaggagagtgcatggaggacaatcctgatagtttggtgaaccaggaagtcctcacaccgggtcagctcttccttatgttcctgaaggaaaaactggaaggttggttagtgtctattaaaatagcttttgataagaaggctcagaagaccagtgtttccatgaacactgacaatttgatgaggatttttacaatgggcatagaccttacaaaaccatttgaatacctttttgctactgggaatctgcgttctaaaacaggtcttggcctcctacaagattctggactttgtgttgtggctgacaagctgaacttcatacgctacctctcccatttccgctgcgtgcacagaggggctgattttgccaagatgaggaccaccacagtacgcaggctgctgccagagtcctggggcttcctttgtcccgtgcataccccagacggggagccctgtggcctgatgaaccacctaactgccgtatgtgaggttgtcacacagtttgtgtatacggcatctattccagctttactgtgcaacttgggggtcactcccattgatggagctccccaccgatcatacagtgagtgctaccctgtcctgctggacggtgtcatggttggctgggtggataaggatcttgctccaggcatcgcagattctcttcgtcattttaaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttacatatttaatgaatacaatttgatgggtctgactatatgcacacacctttgataccatcaccacaatcagggtaataaacatacctgtcatctccacaagtttcctcctgcccctttgttttttgctttttggttgctgttgagtttttgttttgtcttctgtggtaagaacacttaactcaagacctaccctcttaacaaatctttaagtgcacgatatagtattgttaattccaggcaccatgttgtacaacagatctttagaccttacttgtcttgcataactgaagctttatacctgttgaacaactctccatttccctggcccctagcaaccacccttctaccctgtttctatgagtttgactattacagatatctcatatagtgggatcatgcaatatttgtcctgtgactggcttatttcacttagcatagtgaaataagattcatccattttggaagccaggcatggtgctgtgcatctatagtccctgctatttgagaggctgaggtgggaggatcatttgagtgcaggagttcaaggacagcctgggtaatataggaagaccctgtcttgaagaccctgacctcaagtgatccacccacctcggcctccgaaagtgctaggattacaggtgtgagccactgtgcctggcctccggtgagtattttatatttagtctacacttccatacttggcttttttctgcttttatattgatctgctttcatagcagtgtgtagagtgccacttatgttttctttcttgtgtacagtattttattgtatggatttaccatcccctgtgtatttaagttgttccattctttggccattataacttttttctgcaaatattctggtgacttatctttggccattataaactgttgataat

SEQ ID NO: 334073 - DNA, 6143 bp, Homo sapiens
tttttttacactttaaatgtgtggtttattgtatgccagttataacgcaatatagctgttaaacacaaacacaataaagttgaaaaaccagcaggcattccctgattaatcagtattctggggaggtaaggggctcacaggaacgcaaaagaaattcaggctgtaaatccagttggacgccccgctgccccatcccctccatccgggaccgcccgactcctctcccacctccttccccaggcctcccccaggcctccagtccggaagatgcgacgaggttagcggggcccgaccactccttggcttcccaggggtgagcctcgcgagttaggagttgggtagagagtcagcccggggcccggcatccgctttttcgttgaagcaacgactttggccggatgactccccagggtcggcatcagcgtgggactgggaacaggtgaagggaaacagaagagagcctgagaagaccgctctcctccgatcctaattgactgagccaatgagagccaaagaggtcacatgctcaactgggcggggagcgggtttccacctgcggcatctttcgcgagcggggagatgagtggggcggaatatgggagaaagggagggcccgccacgctctggctggacacggccttaatcggcccgttcactcgacgtttttggttctacgttgaccccgagaaaccgaaaccgcagggcctagggcgggtggaacgagagggaactacatttcccagcaggctgcggaaacgggactgcggccactacttccggcgtgtaccgagagactggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggctatacctccctttgaatttgctttcaaagatgagcgtatctcttttactattctggatgctgttatcagtccacctacagttccaaaagggaccatctgcaaagaggccaatgtttatccagcagaatgccggggccgaaggagtacctaccgtgggaagttgacagctgatatcaactgggcagtgaatggaatctcaaaaggaatcattaagcagtttcttggctatgttcccatcatggtgaaatccaagctttgcaacttacgtaaccttcccccacaagccctcattgagcaccatgaggaggcagaggaaatggggggctattttataatcaatggcattgaaaaagtcatccgaatgttgattatgcctcggagaaattttcccattgcaatgataagaccaaaatggaaaaccagagggcctggttatactcagtatggagtttcaatgcactgtgtgagggaagaacattccgctgtcaatatgaacctccactacttggaaaatggcacagttatgttgaactttatttaccgaaaagaactgttctttcttcctttgggatttgcacttaaggcacttgtcagcttttctgattatcagatctttcaggagctcatcaaaggaaaagaggatgattctttccttaggaactctgtttctcagatgttaaggattgtaatggaagagggttgtttgacacaaaaacaggtccttaactacctaggtgaatgcttcagagtaaaactcaatgttcctgactggtacccaaatgagcaagctgcggagttcctgtttaaccagtgcatctgtatccacttgaaatccaatactgaaaagttttatatgctttgtctcatgacgcgaaagctctttgctttagccaaaggagagtgcatggaggacaatcctgatagtttggtgaaccaggaagtcctcacaccgggtcagctcttccttatgttcctgaaggaaaaactggaaggttggttagtgtctattaaaatagcttttgataagaaggctcagaagaccagtgtttccatgaacactgacaatttgatgaggatttttacaatgggcatagaccttacaaaaccatttgaatacctttttgctactgggaatctgcgttctaaaacaggtcttggcctcctacaagattctggactttgtgttgtggctgacaagctgaacttcatacgctacctctcccatttccgctgcgtgcacagaggggctgattttgccaagatgaggaccaccacagtacgcaggctgctgccagagtcctggggcttcctttgtcccgtgcataccccagacggggagccctgtggcctgatgaaccacctaactgccgtatgtgaggttgtcacacagtttgtgtatacggcatctattccagctttactgtgcaacttgggggtcactcccattgatggagctccccaccgatcatacagtgagtgctaccctgtcctgctggacggtgtcatggttggctgggtggataaggatcttgctccaggcatcgcagattctcttcgtcattttaaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttacatatttaatgaatacaatttgatgggtctgactatatgcacacacctttgataccatcaccacaatcagggtaataaacatacctgtcatctccacaagtttcctcctgcccctttgttttttgctttttggttgctgttgagtttttgttttgtcttctgtggtaagaacacttaactcaagacctaccctcttaacaaatctttaagtgcacgatatagtattgttaattccaggcaccatgttgtacaacagatctttagaccttacttgtcttgcataactgaagctttatacctgttgaacaactctccatttccctggcccctagcaaccacccttctaccctgtttctatgagtttgactattacagatatctcatatagtgggatcatgcaatatttgtcctgtgactggcttatttcacttagcatagtgaaataagattcatccattttggaagccaggcatggtgctgtgcatctatagtccctgctatttgagaggctgaggtgggaggatcatttgagtgcaggagttcaaggacagcctgggtaatataggaagaccctgtcttgaagaccctgacctcaagtgatccacccacctcggcctccgaaagtgctaggattacaggtgtgagccactgtgcctggcctccggtgagtattttatatttagtctacacttccatacttggcttttttctgcttttatattgatctgctttcatagcagtgtgtagagtgccacttatgttttctttcttgtgtacagtattttattgtatggatttaccatcccctgtgtatttaagttgttccattctttggccattataacttttttctgcaaatattctggtgacttatctttggccattataaactgttgataatagatcatcttgtatatacttctgcaattataagatgttttttgatgaaagctttcctaaggtaattctttcctgagtttggttcagatggtctgtcactaattataaggcagataggaacagacagaaaaatctatcatttcaagataggcttagcaggatgggcgcagtgccactgcactccagcctgggtgacagagcaggaccctgtctctattttataaattaaaaaaggctgggtgtggtggctcacacccataatcccaacactttggctcagcagattgcttgaacccaggaattcaagtccaatctgggcaacatggggaaaccccagctctacaaaaaaaattagcctggtgtggtggcacatgcctgtagttccagctactcaggaggctgaggtgggagaatctcctgagcctggaaggtccaggcagtgagccaagattgtgccaccacactccagcctgggcgacagaatgagaccctgtctcaaaaaaaaaaaaaaaaaaaaag

SEQ ID NO: 334074 - DNA, 3199 bp, Homo sapiens
atgtgattgtgctgtttgtttcctttaccaggggtcactcccattgatggagctccccaccgatcatacagtgagtgctaccctgtcctgctggacggtgtcatggttggctgggtggataaggatcttgctccaggcatcgcagattctcttcgtcattttaaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttacatatttaatgaatacaatttgatgggtctgactatatgcacacacctttgataccatcaccacaatcagggtaataaacatacctgtcatctccacaagtttcctcctgcccctttgttttttgctttttggttgctgttgagtttttgttttgtcttctgtggtaagaacacttaactcaagacctaccctcttaacaaatctttaagtgcacgatatagtattgttaattccaggcaccatgttgtacaacagatctttagaccttacttgtcttgcataactgaagctttatacctgttgaacaactctccatttccctggcccctagcaaccacccttctaccctgtttctatgagtttgactattacagatatctcatatagtgggatcatgcaatatttgtcctgtgactggcttatttcacttagcatagtgaaataagattcatccattttggaagccaggcatggtgctgtgcatctatagtccctgctatttgagaggctgaggtgggaggatcatttgagtgcaggagttcaaggacagcctgggtaatataggaagaccctgtcttgaagaccctgacctcaagtgatccacccacctcggcctccgaaagtgctaggattacaggtgtgagccactgtgcctggcctccggtgagtattttatatttagtctacacttccatacttggcttttttctgcttttatattgatctgctttcatagcagtgtgtagagtgccacttatgttttctttcttgtgtacagtattttattgtatggatttaccatcccctgtgtatttaagttgttccattctttggccattataacttttttctgcaaatattctggtgacttatctttggccattataaactgttgataat

SEQ ID NO: 334075 - DNA, 3232 bp, Homo sapiens
gcttaacctccagcccctatccccttcctggaggttgagggtgggggtgaaagtcccaatcctctaatcctggcttggtctttctggtgaccagccccatcctgaagccacctagatgctgccaaccaccagtcttttatttttatttttttgagtcagagtcttgtgcctcagcctcctgagtagctgagactacaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttacatatttaatgaatacaatttgatgggtctgactatatgcacacacctttgataccatcaccacaatcagggtaataaacatacctgtcatctccacaagtttcctcctgcccctttgttttttgctttttggttgctgttgagtttttgttttgtcttctgtggtaagaacacttaactcaagacctaccctcttaacaaatctttaagtgcacgatatagtattgttaattccaggcaccatgttgtacaacagatctttagaccttacttgtcttgcataactgaagctttatacctgttgaacaactctccatttccctggcccctagcaaccacccttctaccctgtttctatgagtttgactattacagatatctcatatagtgggatcatgcaatatttgtcctgtgactggcttatttcacttagcatagtgaaataagattcatccattttggaagccaggcatggtgctgtgcatctatagtccctgctatttgagaggctgaggtgggaggatcatttgagtgcaggagttcaaggacagcctgggtaatataggaagaccctgtcttgaagaccctgacctcaagtgatccacccacctcggcctccgaaagtgctaggattacaggtgtgagccactgtgcctggcctccggtgagtattttatatttagtctacacttccatacttggcttttttctgcttttatattgatctgctttcatagcagtgtgtagagtgccacttatgttttctttcttgtgtacagtattttattgtatggatttaccatcccctgtgtatttaagttgttccattctttggccattataacttttttctgcaaatattctggtgacttatctttggccattataaactgttgataat

SEQ ID NO: 334076 - DNA, 230 bp, Homo sapiens
atggcacagttatgttgaactttatttaccgaaaagaactgttctttcttcctttgggatttgcacttaaggtatgacttaatgaatgcattcttttgttatgaagaaattcactgggggtagtatcctgtgcacattggatggattctccttgttaaaataatactgtactagttgtctactgctccaaaacaaattacgtcaaaattcaatagcttaaaactcaataa

SEQ ID NO: 334077 - DNA, 291 bp, Homo sapiens
tgaggtttagaaacatttttgattgccagtcttggctaaacttagtgatttggctttaattgtgtctaagaggttaagattgttcagaaagaaaatggttgaagcaattaagatatcaatgagtttctgatttttttgttgtttggttcaataggagtttcaatgcactgtgtgagggaagaacattccgctgtcaatatgaacctccactacttggaaaatggcacagttatgttgaactttatttaccgaaaagaactgttctttcttcctttgggatttgcacttaag

SEQ ID NO: 334078 - DNA, 606 bp, Homo sapiens
gaaaaaatgccttggaaatgcaagcaatttaatagtgtgaattgcatttcaggctatacctccctttgaatttgctttcaaagatgagcgtatctcttttactattctggatgctgttatcagtccacctacagttccaaaagggaccatctgcaaagaggccaatgtttatccagcagaatgccggggccgaaggagtacctaccgtgggaagttgacagtgagtactagtgatactgtgtgactctcaacactgcacatatttgggagtagggcgggtgcctaataaagtttatgccagaaattgctttcttggtgctattgtctaagagatcccaccttctaaatctaaggcataaaataatttaattgatcttcttcctcagtctttgaaaatactcatttgttctcgtaaatgcagatatttctgttaagtaactttttctcttgttttcatttaggctgatatcaactgggcagtgaatggaatctcaaaaggaatcattaagcagtttcttggctatgttcccatcatggtgaaatccaagctttgcaacttacgtaaccttcccccacaagccctcattgagcaccatgaggaggcag

SEQ ID NO: 334079 - DNA, 4651 bp, Homo sapiens
tttttttacactttaaatgtgtggtttattgtatgccagttataacgcaatatagctgttaaacacaaacacaataaagttgaaaaaccagcaggcattccctgattaatcagtattctggggaggtaaggggctcacaggaacgcaaaagaaattcaggctgtaaatccagttggacgccccgctgccccatcccctccatccgggaccgcccgactcctctcccacctccttccccaggcctcccccaggcctccagtccggaagatgcgacgaggttagcggggcccgaccactccttggcttcccaggggtgagcctcgcgagttaggagttgggtagagagtcagcccggggcccggcatccgctttttcgttgaagcaacgactttggccggatgactccccagggtcggcatcagcgtgggactgggaacaggtgaagggaaacagaagagagcctgagaagaccgctctcctccgatcctaattgactgagccaatgagagccaaagaggtcacatgctcaactgggcggggagcgggtttccacctgcggcatctttcgcgagcggggagatgagtggggcggaatatgggagaaagggagggcccgccacgctctggctggacacggccttaatcggcccgttcactcgacgtttttggttctacgttgaccccgagaaaccgaaaccgcagggcctagggcgggtggaacgagagggaactacatttcccagcaggctgcggaaacgggactgcggccactacttccggcgtgtaccgagagactggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggctgatatcaactgggcagtgaatggaatctcaaaaggaatcattaagcagtttcttggctacgttcccatcatggtgaaatccaagctttgcaacttacgtaaccttcccccacaagccctcattgagcaccatgaggaggcagaggaaatggggggctattttataatcaatggcattgaaaaagtcatccgaatgttgattatgcctcggagaaattttcccattgcaatgataagaccaaaatggaaaaccagagggcctggttatactcagtatggagtttcaatgcactgtgtgagggaagaacattccgctgtcaatatgaacctccactacttggaaaatggcacagttatgttgaactttatttaccgaaaagaactgttctttcttcctttgggatttgcacttaaggcacttgtcagcttttctgattatcagatctttcaggagctcatcaaaggaaaagaggatgattctttccttaggaactctgtttctcagatgttaaggattgtaatggaagagggttgtttgacacaaaaacaggtccttaactacctaggtgaatgcttcagagtaaaactcaatgttcctgactggtacccaaatgagcaagctgcggagttcctgtttaaccagtgcatctgtatccacttgaaatccaatactgaaaagttttatatgctttgtctcatgacgcgaaagctctttgctttagccaaaggagagtgcatggaggacaatcctgatagtttggtgaaccaggaagtcctcacaccgggtcagctcttccttatgttcctgaaggaaaaactggaaggttggttagtgtctattaaaatagcttttgataagaaggctcagaagaccagtgtttccatgaacactgacaatttgatgaggatttttacaatgggcatagaccttacaaaaccatttgaatacctttttgctactgggaatctgcgttctaaaacaggtcttggcctcctacaagattctggactttgtgttgtggctgacaagctgaacttcatacgctacctctcccatttccgctgcgtgcacagaggggctgattttgccaagatgaggaccaccacagtacgcaggctgctgccagagtcctggggcttcctttgtcccgtgcataccccagacggggagccctgtggcctgatgaaccacctaactgccgtatgtgaggttgtcacacagtttgtgtatacggcatctattccagctttactgtgcaacttgggggtcactcccattgatggagctccccaccgatcatacagtgagtgctaccctgtcctgctggacggtgtcatggttggctgggtggataaggatcttgctccaggcatcgcagattctcttcgtcattttaaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttacatatttaatgaatacaatttgatgggtctgactatatgcacacacctttgataccatcaccacaatcagggtaataaacatacctgtcatctcc

SEQ ID NO: 334080 - DNA, 5457 bp, Homo sapiens
tttttttacactttaaatgtgtggtttattgtatgccagttataacgcaatatagctgttaaacacaaacacaataaagttgaaaaaccagcaggcattccctgattaatcagtattctggggaggtaaggggctcacaggaacgcaaaagaaattcaggctgtaaatccagttggacgccccgctgccccatcccctccatccgggaccgcccgactcctctcccacctccttccccaggcctcccccaggcctccagtccggaagatgcgacgaggttagcggggcccgaccactccttggcttcccaggggtgagcctcgcgagttaggagttgggtagagagtcagcccggggcccggcatccgctttttcgttgaagcaacgactttggccggatgactccccagggtcggcatcagcgtgggactgggaacaggtgaagggaaacagaagagagcctgagaagaccgctctcctccgatcctaattgactgagccaatgagagccaaagaggtcacatgctcaactgggcggggagcgggtttccacctgcggcatctttcgcgagcggggagatgagtggggcggaatatgggagaaagggagggcccgccacgctctggctggacacggccttaatcggcccgttcactcgacgtttttggttctacgttgaccccgagaaaccgaaaccgcagggcctagggcgggtggaacgagagggaactacatttcccagcaggctgcggaaacgggactgcggccactacttccggcgtgtaccgagagactggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggctgatatcaactgggcagtgaatggaatctcaaaaggaatcattaagcagtttcttggctacgttcccatcatggtgaaatccaagctttgcaacttacgtaaccttcccccacaagccctcattgagcaccatgaggaggcagaggaaatggggggctattttataatcaatggcattgaaaaagtcatccgaatgttgattatgcctcggagaaattttcccattgcaatgataagaccaaaatggaaaaccagagggcctggttatactcagtatggagtttcaatgcactgtgtgagggaagaacattccgctgtcaatatgaacctccactacttggaaaatggcacagttatgttgaactttatttaccgaaaagaactgttctttcttcctttgggatttgcacttaaggcacttgtcagcttttctgattatcagatctttcaggagctcatcaaaggaaaagaggatgattctttccttaggaactctgtttctcagatgttaaggattgtaatggaagagggttgtttgacacaaaaacaggtccttaactacctaggtgaatgcttcagagtaaaactcaatgttcctgactggtacccaaatgagcaagctgcggagttcctgtttaaccagtgcatctgtatccacttgaaatccaatactgaaaagttttatatgctttgtctcatgacgcgaaagctctttgctttagccaaaggagagtgcatggaggacaatcctgatagtttggtgaaccaggaagtcctcacaccgggtcagctcttccttatgttcctgaaggaaaaactggaaggttggttagtgtctattaaaatagcttttgataagaaggctcagaagaccagtgtttccatgaacactgacaatttgatgaggatttttacaatgggcatagaccttacaaaaccatttgaatacctttttgctactgggaatctgcgttctaaaacaggtcttggcctcctacaagattctggactttgtgttgtggctgacaagctgaacttcatacgctacctctcccatttccgctgcgtgcacagaggggctgattttgccaagatgaggaccaccacagtacgcaggctgctgccagagtcctggggcttcctttgtcccgtgcataccccagacggggagccctgtggcctgatgaaccacctaactgccgtatgtgaggttgtcacacagtttgtgtatacggcatctattccagctttactgtgcaacttgggggtcactcccattgatggagctccccaccgatcatacagtgagtgctaccctgtcctgctggacggtgtcatggttggctgggtggataaggatcttgctccaggcatcgcagattctcttcgtcattttaaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttacatatttaatgaatacaatttgatgggtctgactatatgcacacacctttgataccatcaccacaatcagggtaataaacatacctgtcatctccacaagtttcctcctgcccctttgttttttgctttttggttgctgttgagtttttgttttgtcttctgtggtaagaacacttaactcaagacctaccctcttaacaaatctttaagtgcacgatatagtattgttaattccaggcaccatgttgtacaacagatctttagaccttacttgtcttgcataactgaagctttatacctgttgaacaactctccatttccctggcccctagcaaccacccttctaccctgtttctatgagtttgactattacagatatctcatatagtgggatcatgcaatatttgtcctgtgactggcttatttcacttagcatagtgaaataagattcatccattttggaagccaggcatggtgctgtgcatctatagtccctgctatttgagaggctgaggtgggaggatcatttgagtgcaggagttcaaggacagcctgggtaatataggaagaccctgtcttgaagaccctgacctcaagtgatccacccacctcggcctccgaaagtgctaggattacaggtgtgagccactgtgcctggcctccggtgagtattttatatttagtctacacttccatacttggcttttttctgcttttatattgatctgctttcatagcagtgtgtagagtgccacttatgttttctttcttgtgtacagtattttattgtatggatttaccatcccctgtgtatttaagttgttccattctttggccattataacttttttctgcaaatattctggtgacttatctttggccattataaactgttgataat

SEQ ID NO: 334081 - DNA, 5717 bp, Homo sapiens
tttttttacactttaaatgtgtggtttattgtatgccagttataacgcaatatagctgttaaacacaaacacaataaagttgaaaaaccagcaggcattccctgattaatcagtattctggggaggtaaggggctcacaggaacgcaaaagaaattcaggctgtaaatccagttggacgccccgctgccccatcccctccatccgggaccgcccgactcctctcccacctccttccccaggcctcccccaggcctccagtccggaagatgcgacgaggttagcggggcccgaccactccttggcttcccaggggtgagcctcgcgagttaggagttgggtagagagtcagcccggggcccggcatccgctttttcgttgaagcaacgactttggccggatgactccccagggtcggcatcagcgtgggactgggaacaggtgaagggaaacagaagagagcctgagaagaccgctctcctccgatcctaattgactgagccaatgagagccaaagaggtcacatgctcaactgggcggggagcgggtttccacctgcggcatctttcgcgagcggggagatgagtggggcggaatatgggagaaagggagggcccgccacgctctggctggacacggccttaatcggcccgttcactcgacgtttttggttctacgttgaccccgagaaaccgaaaccgcagggcctagggcgggtggaacgagagggaactacatttcccagcaggctgcggaaacgggactgcggccactacttccggcgtgtaccgagagactggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcagagacggggtctccctatgtggcccagcctggtctcaaactcctgagctcaagtagtcctcctctctcggtctcccaaatattgggattacaggctatacctccctttgaatttgctttcaaagatgagcgtatctcttttactattctggatgctgttatcagtccacctacagttccaaaagggaccatctgcaaagaggccaatgtttatccagcagaatgccggggccgaaggagtacctaccgtgggaagttgacagctgatatcaactgggcagtgaatggaatctcaaaaggaatcattaagcagtttcttggctatgttcccatcatggtgaaatccaagctttgcaacttacgtaaccttcccccacaagccctcattgagcaccatgaggaggcagaggaaatggggggctattttataatcaatggcattgaaaaagtcatccgaatgttgattatgcctcggagaaattttcccattgcaatgataagaccaaaatggaaaaccagagggcctggttatactcagtatggagtttcaatgcactgtgtgagggaagaacattccgctgtcaatatgaacctccactacttggaaaatggcacagttatgttgaactttatttaccgaaaagaactgttctttcttcctttgggatttgcacttaaggcacttgtcagcttttctgattatcagatctttcaggagctcatcaaaggaaaagaggatgattctttccttaggaactctgtttctcagatgttaaggattgtaatggaagagggttgtttgacacaaaaacaggtccttaactacctaggtgaatgcttcagagtaaaactcaatgttcctgactggtacccaaatgagcaagctgcggagttcctgtttaaccagtgcatctgtatccacttgaaatccaatactgaaaagttttatatgctttgtctcatgacgcgaaagctctttgctttagccaaaggagagtgcatggaggacaatcctgatagtttggtgaaccaggaagtcctcacaccgggtcagctcttccttatgttcctgaaggaaaaactggaaggttggttagtgtctattaaaatagcttttgataagaaggctcagaagaccagtgtttccatgaacactgacaatttgatgaggatttttacaatgggcatagaccttacaaaaccatttgaatacctttttgctactgggaatctgcgttctaaaacaggtcttggcctcctacaagattctggactttgtgttgtggctgacaagctgaacttcatacgctacctctcccatttccgctgcgtgcacagaggggctgattttgccaagatgaggaccaccacagtacgcaggctgctgccagagtcctggggcttcctttgtcccgtgcataccccagacggggagccctgtggcctgatgaaccacctaactgccgtatgtgaggttgtcacacagtttgtgtatacggcatctattccagctttactgtgcaacttgggggtcactcccattgatggagctccccaccgatcatacagtgagtgctaccctgtcctgctggacggtgtcatggttggctgggtggataaggatcttgctccaggcatcgcagattctcttcgtcattttaaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttacatatttaatgaatacaatttgatgggtctgactatatgcacacacctttgataccatcaccacaatcagggtaataaacatacctgtcatctccacaagtttcctcctgcccctttgttttttgctttttggttgctgttgagtttttgttttgtcttctgtggtaagaacacttaactcaagacctaccctcttaacaaatctttaagtgcacgatatagtattgttaattccaggcaccatgttgtacaacagatctttagaccttacttgtcttgcataactgaagctttatacctgttgaacaactctccatttccctggcccctagcaaccacccttctaccctgtttctatgagtttgactattacagatatctcatatagtgggatcatgcaatatttgtcctgtgactggcttatttcacttagcatagtgaaataagattcatccattttggaagccaggcatggtgctgtgcatctatagtccctgctatttgagaggctgaggtgggaggatcatttgagtgcaggagttcaaggacagcctgggtaatataggaagaccctgtcttgaagaccctgacctcaagtgatccacccacctcggcctccgaaagtgctaggattacaggtgtgagccactgtgcctggcctccggtgagtattttatatttagtctacacttccatacttggcttttttctgcttttatattgatctgctttcatagcagtgtgtagagtgccacttatgttttctttcttgtgtacagtattttattgtatggatttaccatcccctgtgtatttaagttgttccattctttggccattataacttttttctgcaaatattctggtgacttatctttggccattataaactgttgataat

SEQ ID NO: 334082 - DNA, 4019 bp, Homo sapiens
  misc_feature (87)..(87): n is a, c, g, or t
agcggatagagcgagtgctctcccgtcctgctgaacggggtcgtgatctggctgcggtaggcatagaaggagtgcgtggttgcacanggctatctgggacgagtgtgtctggcggtcagtaatgagcgagtagtctgagcatgtaggacaccggtaattgcctctctgtgtgcactgggaagctcgggtacgtgtggtagctgcagtggacacggaaggagatcgacatgttctggtgagcccctggcagttcgttccatctgttatcaccgattgccctgtgtgtaggaagtggctacgcgcgcgtactgtcttcacacgttaaccacttgcgcgcgactcgcaatgatgctgacaatcgggcatacctaagttgggagagaggagtgcttcctgaaatgtccgagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttacatatttaatgaatacaatttgatgggtctgactatatgcacacacctttgataccatcaccacaatcagggtaataaacatacctgtcatctccacaagtttcctcctgcccctttgttttttgctttttggttgctgttgagtttttgttttgtcttctgtggtaagaacacttaactcaagacctaccctcttaacaaatctttaagtgcacgatatagtattgttaattccaggcaccatgttgtacaacagatctttagaccttacttgtcttgcataactgaagctttatacctgttgaacaactctccatttccctggcccctagcaaccacccttctaccctgtttctatgagtttgactattacagatatctcatatagtgggatcatgcaatatttgtcctgtgactggcttatttcacttagcatagtgaaataagattcatccattttggaagccaggcatggtgctgtgcatctatagtccctgctatttgagaggctgaggtgggaggatcatttgagtgcaggagttcaaggacagcctgggtaatataggaagaccctgtcttgaagaccctgacctcaagtgatccacccacctcggcctccgaaagtgctaggattacaggtgtgagccactgtgcctggcctccggtgagtattttatatttagtctacacttccatacttggcttttttctgcttttatattgatctgctttcatagcagtgtgtagagtgccacttatgttttctttcttgtgtacagtattttattgtatggatttaccatcccctgtgtatttaagttgttccattctttggccattataacttttttctgcaaatattctggtgacttatctttggccattataaactgttgataatagatcatcttgtatatacttctgcaattataagatgttttttgatgaaagctttcctaaggtaattctttcctgagtttggttcagatggtctgtcactaattataaggcagataggaacagacagaaaaatctatcatttcaagataggcttagcaggatgggcgcagtggctcacgccactaatcccaacattttaggaggcctaggcaggagcaatcacttgtgcctgggagttctagactagcctgggcgagacttcatctctacaaaaaaagcaacaacgacaaaaaaaattagccaagcatagtggcacacccctgtagtcccagctacttgggaggctgaggtgggaggattgcttgaacccaagaggtcgaggctgcagtgagccaagattgtgccactgcactccagcctgggtgacagagcaggaccctgtctctattttataaattaaaaaaggctgggtgtggtggctcacacccataatcccaacactttggctcagcagattgcttgaacccaggaattcaagtccaatctgggcaacatggggaaaccccagctctacaaaaaaaattagcctggtgtggtggcacatgcctgtagttccagctactcaggaggctgaggtgggagaatctcctgagcctggaaggtccaggcagtgagccaagattgtgccaccacactccagcctgggcgacagaatgagaccctgtctcaaaaaaaaaaaaaaaaaaaaag

SEQ ID NO: 334083 - DNA, 423 bp, Homo sapiens
  misc_feature (27)..(27): n is a, c, g, or t
  misc_feature (75)..(75): n is a, c, g, or t
  misc_feature (85)..(85): n is a, c, g, or t
gggaaattgtgaaacggaataaacaantttccacaacaggaaaaacaacctatgacccatgaatttaaccccaancttggccacnaggtgaaaaacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactagatgatggttgcatgtttctagtttgtatatgtttccatctttgtgataagatgatttaataaatctctttaaatactta

SEQ ID NO: 334084 - DNA, 1615 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatactta

SEQ ID NO: 334085 - DNA, 1094 bp, Homo sapiens
  misc_feature (30)..(30): n is a, c, g, or t
  misc_feature (523)..(523): n is a, c, g, or t
  misc_feature (525)..(525): n is a, c, g, or t
  misc_feature (527)..(527): n is a, c, g, or t
  misc_feature (530)..(530): n is a, c, g, or t
cgaacaaaagacaacatattttatatcaancaagtttgaagagccctggaattgcagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatacttaaaaaaaaaaaaaaaaaaaaaaaaaaaaaaanananaanaaaaaaaaaaaaaaaaaaaaaaaaaaaaaaaaaaaaaaaaaaaaaaaaaaaattaaagaggagaaacagagaagctaatcatacaacaaaaaatatacctctattaaacagaagcagacgacatccataactacacagcgcagtccttgcagcacctgacacgagacctctccccacatgacaaacatctctcgaccgaacactccgcatcagcaaccctctgcgtaggagaggccaaccttagggagacgacacatgtgacaaaccccaccacccagggggggactacaaacccaaccgagccaccgacccaatcacaaccgacgcaagccacacacccaccagctagggcgacaccagcaacaaccagcacaatgacggggagcgacccacgaggaggagaaagaaacacaacacaacgagacgcccgcactcatgacacgcggaagaccaaaaaaaccaccaacgacagcgaacggtccagcaaacacaacacaacaccacaaacacacgccaagcacacacacccagcacaccaagcaagaccaagcctaacagcccgca

SEQ ID NO: 334086 - DNA, 327 bp, Homo sapiens
agtttgcggtgatctagaggatcccgaggtaatcgaggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcaagccaatatgggtaagagctc

SEQ ID NO: 334087 - DNA, 1439 bp, Homo sapiens
  misc_feature (30)..(30): n is a, c, g, or t
gggttttggcttcctgccccccgggtgtangatatcgtcgaccacgcgccggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatactta

SEQ ID NO: 334088 - DNA, 2217 bp, Homo sapiens
  misc_feature (1646)..(1646): n is a, c, g, or t
  misc_feature (1648)..(1648): n is a, c, g, or t
  misc_feature (1650)..(1650): n is a, c, g, or t
  misc_feature (1653)..(1653): n is a, c, g, or t
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatacttaaaaaaaaaaaaaaaaaaaaaaaaaaaaaaanananaanaaaaaaaaaaaaaaaaaaaaaaaaaaaaaaaaaaaaaaaaaaaaaaaaaaaattaaagaggagaaacagagaagctaatcatacaacaaaaaatatacctctattaaacagaagcagacgacatccataactacacagcgcagtccttgcagcacctgacacgagacctctccccacatgacaaacatctctcgaccgaacactccgcatcagcaaccctctgcgtaggagaggccaaccttagggagacgacacatgtgacaaaccccaccacccagggggggactacaaacccaaccgagccaccgacccaatcacaaccgacgcaagccacacacccaccagctagggcgacaccagcaacaaccagcacaatgacggggagcgacccacgaggaggagaaagaaacacaacacaacgagacgcccgcactcatgacacgcggaagaccaaaaaaaccaccaacgacagcgaacggtccagcaaacacaacacaacaccacaaacacacgccaagcacacacacccagcacaccaagcaagaccaagcctaacagcccgca

SEQ ID NO: 334089 - DNA, 1551 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcccgagccgataatatttgcccatccgactttcccgtcaggatccccacaaacatgtcc

SEQ ID NO: 334090 - DNA, 1578 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcgggccgcatacagtactgttgcagatcagatcctgactggtgcactctctcacagcgccagtcctaaccatgggcatcatctatgagcgcttgctgctcacacatgataacgtgctcgtgtgtacagctt

SEQ ID NO: 334091 - DNA, 1594 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatactta

SEQ ID NO: 334092 - DNA, 1178 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttgggttctgtaccgatgtgcatcgggcctccctgtggtaccttctggcccggtcctcttttcaccccagggcctgcccgt

SEQ ID NO: 334093 - DNA, 1417 bp, Homo sapiens
  misc_feature (70)..(70): n is a, c, g, or t
ggacgatctgatgtggtgtgtgggtacagtgcgcttgaataacatgccaggtttagactgtttggagctngtcagagggtgagacgaaacagttatgttcaagagcagtcgccgaggactaggaagtgagcggccgacctcgtataactacttggtcgatctcatcagatgttatcactggcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatactta

SEQ ID NO: 334094 - DNA, 1419 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctatttcacaatcgaagaatgatctaatattaaaaacatgaaatgaatccaagccagacagtactgagtttttacacaagcctcttttgtattcaatgttgtttattgaggagtgaatgagagactactgccagacatgccaatgacacttcacattcaagggctggaagctggaaagcttcccgactgagtcactgtataagccttctgggaaaaagaaccaacgtgacatcaaatatgccatcttcatgcttgttgtctgtcatcagtttttttcaacttttgggtctactggtttgctgggtaggaggcttcttctaccctacagaaagactcacctacctattcacaatcggtaccgag

SEQ ID NO: 334095 - DNA, 1542 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatgttcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatactta

SEQ ID NO: 334096 - DNA, 1423 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcttcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatactta

SEQ ID NO: 334097 - DNA, 1567 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacaataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatactta

SEQ ID NO: 334098 - DNA, 1538 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgtatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatactta

SEQ ID NO: 334099 - DNA, 1048 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgtttgccaactatgaatgccgtgaaatgcttgaaaaccgcaggcttttcctaatgtagag

SEQ ID NO: 334100 - DNA, 1033 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaagggtcacctccttacgtgggttggaccgggaaaattcatcacacccgaatgtgccggaattgcggttcctgtcttaagccctcccagcgttggcactatgatgcggaatccgaccacccattccccctctgccgaactcccctttggg

SEQ ID NO: 334101 - DNA, 835 bp, Homo sapiens
  misc_feature (808)..(808): n is a, c, g, or t
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactattggacttcaggtgcctnctgttcattggtcttgggttccttgct

SEQ ID NO: 334102 - DNA, 619 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctggtatgtgtttaatagaaaaacaaaaaaat

SEQ ID NO: 334103 - DNA, 1133 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacattcagtatgaagtcatcggtaattactattcgtctgagagaatggtgataatgctatgaaatggcgtgaaaatgctgaaaaagaagcacactcttacttactgctgaagaaattctggctttgaccagtaattctatacagttggagggtatgttacagaatgctgactcagggtcttcaacgtgtttgatataaattatgtgtttgtagcattttttcacacataagagcttttgctttgtaacgcttggcggtaaggcttactttaaaatttgggaccttagtagcaacaaggctgtggtctaaggggtggggaaggtggcactttaagggtaaaagggagggacggcccaagaaaagggagggtacattgagaattttgtt

SEQ ID NO: 334104 - DNA, 890 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacagattctgtaactcttcctccattatcttttcttttgttattattgggttataaatgccttgtttcttttttcttatttttttttttttgtttctttcgccgttcgccacctttttttttgagtatcttttttcttaattttgttttttcgtggttcctatcttatcgtttcctgaccttttttctttcttcttctatctcccttgtttgtcccttctttttactatctacttttccccttcttcatttattttttttctctattttttattttccttgaacacttttcactttctttctgtttttatttttctcttttctctcctcttctgcttcttttctttcctcg

SEQ ID NO: 334105 - DNA, 583 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactagatgatggttgcatgtttctagtttgtatatgtttccatctttgtgataagatgatttaataaatctctttaaatactta

SEQ ID NO: 334106 - DNA, 1877 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatacttaaaaaaaaaaaaaaaaaaaaaaaaaaaaatttggggggggctgggcccggaaaaacttttcaaaaccttcggtgggggccgggcccctttggttacgtaacacgggccaaggctgtcccaaggagaccgggccaagacaaggcgggggattccccccaataaaaaaacgccgcgggaaacaggaaggttcgcggggaaagcccaaggggacccgaagggacaaagggggcctcccaggggggcccaaggagccgaataataca

SEQ ID NO: 334107 - DNA, 1463 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttagatgatggttgcatgtttctagtttgtatatgtttccatctttgtgataagatgatttaataaatctctttaaatactta

SEQ ID NO: 334108 - DNA, 1561 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatatgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatactta

SEQ ID NO: 334109 - DNA, 1196 bp, Homo sapiens
agtttgcggtgatctagaggatcccgaggtaatcgaggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatactta

SEQ ID NO: 334110 - DNA, 1301 bp, Homo sapiens
tctcagcgagcagatcttgcttgttgaggaacaggatcacagagatggtgcgcagccatctgttgttccagatgctcttgaagaggttcagagcctcctgcaggcggttggtctggttgtcctcccggatgaccatgttgtagctgctgctggccaccacgaagatgatggcagtcacatcgttgaagcactggatccacttgcggcgttcatcgcgctggccacccattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatactta

SEQ ID NO: 334111 - DNA, 1623 bp, Homo sapiens
  misc_feature (998)..(998): n is a, c, g, or t
  misc_feature (1009)..(1009): n is a, c, g, or t
  misc_feature (1015)..(1015): n is a, c, g, or t
  misc_feature (1017)..(1017): n is a, c, g, or t
  misc_feature (1019)..(1019): n is a, c, g, or t
  misc_feature (1025)..(1025): n is a, c, g, or t
  misc_feature (1039)..(1039): n is a, c, g, or t
  misc_feature (1047)..(1047): n is a, c, g, or t
  misc_feature (1059)..(1059): n is a, c, g, or t
  misc_feature (1063)..(1063): n is a, c, g, or t
  misc_feature (1094)..(1095): n is a, c, g, or t
  misc_feature (1097)..(1099): n is a, c, g, or t
  misc_feature (1102)..(1102): n is a, c, g, or t
  misc_feature (1112)..(1112): n is a, c, g, or t
  misc_feature (1136)..(1136): n is a, c, g, or t
  misc_feature (1148)..(1148): n is a, c, g, or t
  misc_feature (1157)..(1157): n is a, c, g, or t
  misc_feature (1159)..(1159): n is a, c, g, or t
  misc_feature (1178)..(1178): n is a, c, g, or t
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgcccncccaccccacncccccncnancccccnaaacagaccccccncccccccncccccccccccnaagnaacccccccccccacaatcaaccccacaccnncnnntcncccccccccncccacacaacgccgcaacccagcnccccccaccacntctcctcanancaaataccgcttctctttngctcccaagccatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatactta

SEQ ID NO: 334112 - DNA, 1038 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacggtacgccctacctgttcgagtgccgctgcgaatgcctgggtcgatccag

SEQ ID NO: 334113 - DNA, 958 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactaaaatcccgggttttcctttacagattaaccttggggcttggctttaaatgtctcctggtcaaaaggggttgggggttttgccctattacaatttttaagggggtttttaaaaaacccgttttggaactctttaaaacttattacccacttcccttgtgttcccccctt

SEQ ID NO: 334114 - DNA, 1174 bp, Homo sapiens
caactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttctctttattcaagtggggttgggctgattcccatttctttctggttaaccggacttttttgaccttccgctccttcaaggttggccttgttttggctaattaagttcttcttcaccctatgtttggccaaggaattccacgaataattctgtgcgagtcacactttactctggatttttccccttataccaaaggatttgaccttcctgtgggcgcttgggaattccaaggtttggccttccttggtctcatgggtcccttgggtggtctcttggcgccttttaattgtccagatcagcatttttcgtaaaggggcggcttaaattcgaaaattttcaaacacgggcggtgtctcggggagcaccccggggctttatatgacagcttcgcgcttttcaacacaagaaagcccgggaaaaacttgttgtcccccgggagagaaaatattgcgcgtgtgtgtagataccccccttgtggcccttgtttggagaagacccaccactctacag

SEQ ID NO: 334115 - DNA, 287 bp, Homo sapiens
caattagcaaaatgtgactacggactttatgttagataatagcactgtatcagtgttaaattctccgaatttcttttttttttttttttttttttttttttttttttttttttttttgtggggcccccccgggggggcccccggggggggggccccccggggggggggggcggggggacaaagcggggggactccacacacatatgccgcggggggggggagcgggggccaccgggggggggatcaccatcccccccgacaggcggagaggcaggggccccgggaaa

SEQ ID NO: 334116 - DNA, 162 bp, Homo sapiens
cctgacctcttacccctcccagaggaaccttctcatagtagcccaggaaaacccattccattcaaacatgaaaaagaaaaagggatatgatcgaacactttatgaagttattaaaaggcataaaaagttgaaaatctcataatgtttcacaaggcaataaga

SEQ ID NO: 334117 - DNA, 891 bp, Homo sapiens
  misc_feature (843)..(843): n is a, c, g, or t
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccaaaaaaaaaaaaaaaaaaaaaaaacaaaacaaacaaacaaaaaaacaaaaaaaaaggggggggggggcaaaaaaaacccncagggggagaatacacaccccttgttataaagggcccccatgggggaa

SEQ ID NO: 334118 - DNA, 1090 bp, Homo sapiens
  misc_feature (1042)..(1042): n is a, c, g, or t
agggcaactacggggtagcggacatccgccaggcacgcttctagggccgcttctgcaactgcgcatgcgcttgggctgcacccattccgtctagcccaaaaggttcctctacaaccttcctccggattggtctatagggacacgatggccttttacgcaagcgtcacccgtgctgacccggaagttttcttcccagttaaaagtgttgggccgcggcgcgcggctcttcctgtctgtaccaggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccaaaaaaaaaaaaaaaaaaaaaaaacaaaacaaacaaacaaaaaaacaaaaaaaaaggggggggggggcaaaaaaaacccncagggggagaatacacaccccttgttataaagggcccccatgggggaa

SEQ ID NO: 334119 - DNA, 1134 bp, Homo sapiens
agggcaactacggggtagcggacatccgccaggcacgcttctagggccgcttctgcaactgcgcatgcgcttgggctgcacccattccgtctagcccaaaaggttcctctacaaccttcctccggattggtctatagggacacgatggccttttacgcaagcgtcacccgtgctgacccggaagttttcttcccagttaaaagtgttgggccgcggcgcgcggctcttcctgtctgtaccaggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagctttggggcagtcccagccaaaaaaaaaaaaaaaaaacaaaaaaaaaaaaccgggggttttttggggggggaaaaaggggttaaaaggggctgggtttgttttcgcgacccctttttgaaggggggaaacgcgggccccccaaaggggggataattaaaaccgggtccctatat

SEQ ID NO: 334120 - DNA, 846 bp, Homo sapiens
  misc_feature (22)..(22): n is a, c, g, or t
  misc_feature (29)..(29): n is a, c, g, or t
  misc_feature (35)..(35): n is a, c, g, or t
taaactacggctaggaggaggncggtgtnatcggncgaggccaggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagcaaaaaaaaaaaaaaaaaaaaaaaaaaaaaaaaaaaaaaaaaaaaaaaaaaagaaaaaaaaaaaaaaaaaaaaggggggggggg

SEQ ID NO: 334121 - DNA, 848 bp, Homo sapiens
ggacgcgtgggtcgacccacgcgtcgcggacgcgtgggtaccaggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccagtccaacgtgatttcccagctgtgccaataaactgttgccttggggagtccagcaaaaaaaaaaaatccggggtttgggggggaaaaggctacagggccggcaggttccgacctttttccccggcaacccggccaagggcaaataaacgct

SEQ ID NO: 334122 - DNA, 915 bp, Homo sapiens
gggacttggagcccattcctagtcgcacctcctcagaattcaggaccaacaaaatcctctttagcaaggagaaataatcctgctaatgtggcatttcgtggatcagcaggggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccagtccaacgtgatttcccagctgtgccaataaactgttgccttggggagtccagcaaaaaaaaaaaatccggggtttgggggggaaaaggctacagggccggcaggttccgacctttttccccggcaacccggccaagggcaaataaacgct

SEQ ID NO: 334123 - DNA, 1007 bp, Homo sapiens
  misc_feature (777)..(777): n is a, c, g, or t
ggctggtgctcaagctaccatggcagacgatgatgctagctgctgttcctcagacagtggatggcgctgtacagacgaaggacctgggcgcggactaaaaacctctccacagtgatatgccatctgggaacagtgtcacgctaccacgttcaattctgacgaggatcgacactaacacgactactgcctgtcgtggcagagtgcacagagctggccagtgtgagatcgcaatcaatcatgccatcatcacactagctccctggtcgtgagccacggcagttgcagcgtgcagggagggctagggcctgtgtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaaccgctgtcttcctttggggcagncccagccaaaaaaacaaaaaaaaaacaaacaacaaaaaaacaaaagaaacaaacaaaaaagggggggggcgccgcccaaaaaaaatcccccaggagggggcaccagtaccgggccccacgtttctttgagaaaagggggccaaaaaggggcgcgataaacacagcaggcaggggccggtaaacacgccggagcgcgaaacggcgccggagttcggagagaccacaccggg

SEQ ID NO: 334124 - DNA, 1392 bp, Homo sapiens
agggcaactacggggtagcggacatccgccaggcacgcttctagggccgcttctgcaactgcgcatgcgcttgggctgcacccattccgtctagcccaaaaggttcctctacaaccttcctccggattggtctatagggacacgatggccttttacgcaagcgtcacccgtgctgacccggaagttttcttcccagttaaaagtgttgggccgcggcgcgcggctcttcctgtctgtaccaggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattaccattgcagtgaaaggacgaacgttattgcccaagttacctgccttcacaagtggcagggccgggtaatgcacggccaaaacagctttcccggcaaaagcctccaggttggtccccatttgtggggagcaggcccttcacttagaccttccatggattgaattgccccgggccggcaacaaaccgagccaaggaaaggctccatggacttggttgccggcaattcggttcaaaggcattggccctttccgacaggactccattacaccctggcttcaaccagggcggaagaaaccccttcttgcaagggttccctgggtggaaaacggcccatcattcaaagcaaggttggtgttcccccggggggaaggggaacttcccatctagcggccattgttggcggcggccgccctcggggaactcggtcggaggaccctgaaccagggcttggctggcggaatcgctgttcaccccccacttgtcggcccgttggtggcaacccaggggccagttccttgcggcttggcgtggttgtccacccagggcgggctacgttggcagcgggcttcggccccttttcccggggtgacaccacttttcaaggaaaccccagctgtcggggcgatgagaacgcttgggccgcttgggggcacgagcgagttgcactgccttcaagttcataataggccttggccccaacggggcgtgtcccctttcgggaaaacgctttcccttaacttgcccccagctcgtcacgaaaccgcacaggggaaccgaacgcgacttgggcaaggacgtttgagtggtcgcccaaagtttccacaaagccaggacctggtattgtgctcacccccaggacttcgccttgggcaccctcgagttacacgacccctggtagtcttcgggccccctcatcggagggcccagacgtcccccgctttaagaaccagcatcatgaccaagacacaacgtcatcagacgaagca

SEQ ID NO: 334125 - DNA, 1128 bp, Homo sapiens
  misc_feature (1028)..(1028): n is a, c, g, or t
  misc_feature (1038)..(1038): n is a, c, g, or t
  misc_feature (1041)..(1041): n is a, c, g, or t
agggcaactacggggtagcggacatccgccaggcacgcttctagggccgcttctgcaactgcgcatgcgcttgggctgcacccattccgtctagcccaaaaggttcctctacaaccttcctccggattggtctatagggacacgatggccttttacgcaagcgtcacccgtgctgacccggaagttttcttcccagttaaaagtgttgggccgcggcgcgcggctcttcctgtctgtaccaggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagcaaaaaaaaacacaacaaaaaaccacaccaacaaacaccaaacaacaaaaaaaagggggggggcgaanataccggggnccnaacgcccccttttggaggggccagagggcaaaacagcagcggggaaaggggggacgcgtggttggggacctcggggcgggcacccag

SEQ ID NO: 334126 - DNA, 930 bp, Homo sapiens
  misc_feature (830)..(830): n is a, c, g, or t
  misc_feature (840)..(840): n is a, c, g, or t
  misc_feature (843)..(843): n is a, c, g, or t
ggacgcgtgggtcgacccacgcgtcgcggacgcgtgggtaccaggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagcaaaaaaaaacacaacaaaaaaccacaccaacaaacaccaaacaacaaaaaaaagggggggggcgaanataccggggnccnaacgcccccttttggaggggccagagggcaaaacagcagcggggaaaggggggacgcgtggttggggacctcggggcgggcacccag

SEQ ID NO: 334127 - DNA, 935 bp, Homo sapiens
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagctttggggcagtcccagccaaaaaaaaaaaaaaaaaacaaaaaaaaaaaaccgggggttttttggggggggaaaaaggggttaaaaggggctgggtttgttttcgcgacccctttttgaaggggggaaacgcgggccccccaaaggggggataattaaaaccgggtccctatat

SEQ ID NO: 334128 - DNA, 918 bp, Homo sapiens
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagcggggcagcccagcaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaggggggggggg

SEQ ID NO: 334129 - DNA, 845 bp, Homo sapiens
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagcaaaaaaaaaaaaaaaaaaaaaaaaaaaaaaaaaaaaaaaaaaaaaaaaaaagaaaaaaaaaaaaaaaaaaaaggggggggggg

SEQ ID NO: 334130 - DNA, 987 bp, Homo sapiens
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagcgcaagcacagcaaaaaaaaaaaaaaaagaaaaaaaaaaaggaggggggggctaaaatattcggaggggccaattgagcgccccgttttttacaaggggccaaagggggaataaaaagaggggggggtacaagcgggtggacaggctggcttggaggcccctcgcgtggcatgacaccccagtagccgataatacgtggaccgttgggtgtaattattacacacgg

SEQ ID NO: 334131 - DNA, 1228 bp, Homo sapiens
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagcaaaaaaacaaaaaaaaaacccttcacaatctgggcaagccaaaggccatttatccggggaaccattatcaggaaaaaaattctacctcttttatacttaatcttccctacatatttccccttttaatactaattagttcttatagaaagaacaaaccaacacaaacagccacaaaaaaaatcgacacaacaacacaacacaagaagtcaacccgaaaaacaaaacgcgaccagccaaaacagagaggaggggggcggcggcagataaaaaaagcaccaacgcggcgggggacacccaagagagcatacaccacaccagattgatgtaagcagaggaaggggccccacaaagggagcgggcacttaaataaaccaccacacgacggcgggagataaaaaaagaggcggcgtgagacacacacaacgtcacggagacatctgtaaaaagaacactctggcggggggaa

SEQ ID NO: 334132 - DNA, 1245 bp, Homo sapiens
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagcaaaaaaaaaaaaaaaaaaaaaaaaaaaccccgggggccccaaaggcggggggggggaaaaaaggggaaagagaaggggcccagggcgcccaacgcggggcccggagcccccagtttcctcggggcccaggggggaaacccgcggggcccccaaaagggagcgcccataacttcgaaacccaggtaacccggggatagacccgcgccacacccccccccaccaccccgccgccacccccccccccaccaccccccccccaccacccccccccacccccccacccccccccccccccgcaacagagacaaccagcgcagacccaaccgacaacccgccaaccacgacgccgaaaccccggcccccccccccgcacaagcgccagccccaccgacagagcggcagacacgagcaaagcagccgaccccgcgacacacaaacgcacgcgcaggccgaccacaccaacagcaccgcgacctcacgaca

SEQ ID NO: 334133 - DNA, 958 bp, Homo sapiens
  misc_feature (801)..(801): n is a, c, g, or t
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagctttgggcagccccagcaaaaaaaaaacattaggaaatcngcactttggggcccccatccccctttcgccggggaaaaaagaaaacttttttcaattagatttggaaactatttacccggatgagttaaaaattatttaaggtctaggcttaacaaaccttttttgaagttaaaaggagggattgccctcttaaagg

SEQ ID NO: 334134 - DNA, 822 bp, Homo sapiens
  misc_feature (783)..(783): n is a, c, g, or t
  misc_feature (818)..(818): n is a, c, g, or t
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccagcaaaaaaaaaaaaaaaanaaaaaacaaaaaaaacaaaaaaaaaaaagaaaaanaaaa

SEQ ID NO: 334135 - DNA, 866 bp, Homo sapiens
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagcaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaggggggggggg

SEQ ID NO: 334136 - DNA, 926 bp, Homo sapiens
aaaaccttacggctaggtacgaggcctgggtgttactacgccgagtgacaggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagcggggcagcccagcaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaggggggggggg

SEQ ID NO: 334137 - DNA, 871 bp, Homo sapiens
  misc_feature (823)..(823): n is a, c, g, or t
aaaaccttacggctaggtacgaggcctgggtgttactacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccaaaaaaaaaaaaaaaaaaaaaaaacaaaacaaacaaacaaaaaaacaaaaaaaaaggggggggggggcaaaaaaaacccncagggggagaatacacaccccttgttataaagggcccccatgggggaa

SEQ ID NO: 334138 - DNA, 1228 bp, Homo sapiens
  misc_feature (737)..(737): n is a, c, g, or t
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaaccntggggccagcccccagctaaccaaacacacaacgcacacaccccacacacacaccacctggggggccgcgcacccccgccccgcagaacacaactcccaccaaaacccacgttggggcgaccagcgcgcccacccacgaccacccgcacaccaccgcccaacgacgtccccaagagaaaccgcggccaaacaaggcggcatctccccaataaaacacccccggaggaccacgcggttgtcacaccccgaaaggggccgaggccaccaaggaccccacacgggatccacagcccgttacatcgcgcccgcggtccacgacccacatcacactcgccgcacatcacgcgcaggccgccacacaaccgcaacccacccaccacacacccgccagacacgagcacactcacgacacccacaccaacacagcaccagcagcaccaccccccacacccccaccccccgccaacacccccccacaccccacagcccca

SEQ ID NO: 334139 - DNA, 1297 bp, Homo sapiens
  misc_feature (746)..(746): n is a, c, g, or t
  misc_feature (1288)..(1288): n is a, c, g, or t
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaaccttggggcagncccagaaaaaaaaaagaaaaaaagaaaaacaaagaaacaaaaacgaacaacaaaaagataagacaaaagaaaaaaaaaaaaacaagagggggcgcgccgcgggcgcatgaagaagttcccccacgagggggggccccatacttttcgcgcgccccccggctttttttgtagaccaggcggggccccataaggaggggcgatataaaaaaggcacgcgagcgggcgcagtgtttaaacccggctcggtgggggggcagccggcggcgcgggggacctctgtggggagaggcccccaaccctgcgcggggggcacacttttccggaccccccccccagagagaatataagggcccggggaaaaaaacccaagcggttttggtgttgaacccccgagcgaatttcctggggcaagaaatttggtccggctttttttaaacgtcgcgagccctcaataatcacctacgcatcgaaaaaacgagacgagccaaaagaggaaatagctcacaaactagcaagacaacataacatacaacacgtcaganagaaaaagt

SEQ ID NO: 334140 - DNA, 1032 bp, Homo sapiens
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaaccggggcagcccagcaaaaaaaaaaaaaaaaaaaaaaaacaaaaaaaaaaaaaaaaacaaaacaaaaacccccgggcccctttttgggggggggggaaaaggggttaaaaaaggggcacaggggccaacgggtacccgaacccaaaaaaggaaacaggggggaaaaaacgggggcccccaaaaggggaggaggtcttaaaatccgcaaaaccgccgggtaaccggcgtatatggcagcctcccacacaaaccacacccacaaacaccaagcaaacacaacagcgcacactaagacaac

SEQ ID NO: 334141 - DNA, 987 bp, Homo sapiens
  misc_feature (757)..(757): n is a, c, g, or t
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaaccgctgtcttcctttggggcagncccagccaaaaaaacaaaaaaaaaacaaacaacaaaaaaacaaaagaaacaaacaaaaaagggggggggcgccgcccaaaaaaaatcccccaggagggggcaccagtaccgggccccacgtttctttgagaaaagggggccaaaaaggggcgcgataaacacagcaggcaggggccggtaaacacgccggagcgcgaaacggcgccggagttcggagagaccacaccggg

SEQ ID NO: 334142 - DNA, 848 bp, Homo sapiens
  misc_feature (809)..(809): n is a, c, g, or t
  misc_feature (844)..(844): n is a, c, g, or t
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaaccggggcagcccagcaaaaaaaaaaaaaaaaaaaaaaaacaaaaaaaaaaaaaacagcaaaaaaaaaaaaaaaanaaaaaacaaaaaaaacaaaaaaaaaaaagaaaaanaaaa

SEQ ID NO: 334143 - DNA, 871 bp, Homo sapiens
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaaccggggcagcccagcaaaaaaaaaaaaaaaaaaaaaaaacaaaaaaaaaaaaaaaaaaaaaaaaaaaaaaaaaaaaaaaaaaaaaaaaaaaaaaaaaaaaaaaaagaaaaaaaaaaaaaaaaaaaaggggggggggg

SEQ ID NO: 334144 - DNA, 982 bp, Homo sapiens
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaaccttggggcagtcccaggcccaagaaaaaaaacaaaacaaaaagaaaacaaaaaaaacttgtgtgggggccgcgactgcggcgccccgggaaaaagcttttcaaaaaccacttgcgtggggggccggggggcccccgagtggtcagcgggacccggggcctagaggggtcccgaggaaacccggggccggaaaagggcgggttccccccataaaaaggccggggcaacggaggttggacaaccaaggg

SEQ ID NO: 334145 - DNA, 1093 bp, Homo sapiens
  misc_feature (1045)..(1045): n is a, c, g, or t
agtgtgaggacgtatggcatctgctgagccattataccttggtcccagtgcagcagctgttgactggtggctgccaagtcttgggcccaggggttctaggtgaaagacagatgcttcttgctgacagctgagtaatttttctagtgcttgaaaacacgttcacggcctttcttggtcctttgcgaccccccagttcatcactagatggcggctagcctcagagttgggaatgagtgcgcctttgctccatgctagctgagctctgacgtttttttcctgtcatcaccctgtcccaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccaaaaaaaaaaaaaaaaaaaaaaaacaaaacaaacaaacaaaaaaacaaaaaaaaaggggggggggggcaaaaaaaacccncagggggagaatacacaccccttgttataaagggcccccatgggggaa

SEQ ID NO: 334146 - DNA, 836 bp, Homo sapiens
  misc_feature (54)..(54): n is a, c, g, or t
  misc_feature (86)..(86): n is a, c, g, or t
  misc_feature (788)..(788): n is a, c, g, or t
gcaccgatgatgtgcagatcaatggtgctccacttcccaaagagcttgatgtcnggggtctctgccaccgctggtgctgctgtctnccatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccaaaaaaaaaaaaaaaaaaaaaaaacaaaacaaacaaacaaaaaaacaaaaaaaaaggggggggggggcaaaaaaaacccncagggggagaatacacaccccttgttataaagggcccccatgggggaa

SEQ ID NO: 334147 - DNA, 847 bp, Homo sapiens
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccagtccaacgtgatttcccagctgtgccaataaactgttgccttggggagtccagcaaaaaaaaaaaatccggggtttgggggggaaaaggctacagggccggcaggttccgacctttttccccggcaacccggccaagggcaaataaacgct

SEQ ID NO: 334148 - DNA, 762 bp, Homo sapiens
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagatcctaaaccgcatgctatttatccctaagactgctgcaccaataaacctgtctgccctttggg

SEQ ID NO: 334149 - DNA, 1096 bp, Homo sapiens
  misc_feature (1048)..(1048): n is a, c, g, or t
agggcaactacggggtagcggacatccgccaggcacgcttctagggccgcttctgcaactgcgcatgcgcttgggctgcacccattccgtctagcccaaaaggttcctctacaaccttcctccggattggtctatagggacacgatggccttttacgcaagcgtcacccgtgctgacccggaagttttcttcccagttaaaagtgttgggccgcggcgcgcggctcttcctgtctgtaccaggcggcgcgtggtctacgccgagtgacagagacgctcaggctgtgttctcaggatgaccgagtgggagacagcagcaccagcggtggcagagaccccagacccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccaaaaaaaaaaaaaaaaaaaaaaaacaaaacaaacaaacaaaaaaacaaaaaaaaaggggggggggggcaaaaaaaacccncagggggagaatacacaccccttgttataaagggcccccatgggggaa

SEQ ID NO: 334150 - DNA, 845 bp, Homo sapiens
  misc_feature (10)..(10): n is a, c, g, or t
  misc_feature (15)..(15): n is a, c, g, or t
  misc_feature (797)..(797): n is a, c, g, or t
tccgcacaancatanggctaggtacgaggctgggtgttacaggatgaccgagtgggagacagcagcaccagcggtggcagagaccccagacccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccaaaaaaaaaaaaaaaaaaaaaaaacaaaacaaacaaacaaaaaaacaaaaaaaaaggggggggggggcaaaaaaaacccncagggggagaatacacaccccttgttataaagggcccccatgggggaa

SEQ ID NO: 334151 - DNA, 884 bp, Homo sapiens
  misc_feature (836)..(836): n is a, c, g, or t
tcagctcggtacctgtataactgagggtgtgctcgtgtaatgacggttatgatatcactggctgggttgatcatgagatcacactagtgtgatagtaacatatgtagagggagtatagagcgcgcgatactttagacgccatgctgacagtgcatgcacacgcttgagtgtgggactgcacgtatataacgtccaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccaaaaaaaaaaaaaaaaaaaaaaaacaaaacaaacaaacaaaaaaacaaaaaaaaaggggggggggggcaaaaaaaacccncagggggagaatacacaccccttgttataaagggcccccatgggggaa

SEQ ID NO: 334152 - DNA, 618 bp, Homo sapiens
  misc_feature (577)..(577): n is a, c, g, or t
  misc_feature (589)..(589): n is a, c, g, or t
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgagcncttccgcaactngtacagcacgggggatcctcaagatcagc

SEQ ID NO: 334153 - DNA, 794 bp, Homo sapiens
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggtgagcctggggcttatgcacgtggcagggtggacacagccacgggagtgggtggggtcttgcctggggcaggaaggctcctctctgtctgcatgttttacctgcagcatcacttcctctaggaagccttcctggattcccaccctgcataggggctgatccaggctctgggtcctcttcgggaacacatttggcagaggtcttctttctttcctttgggtgtatatttttacactgtgtgtatatgtactt

SEQ ID NO: 334154 - DNA, 592 bp, Homo sapiens
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgcacttacgcgcgtaaggaccgggatcctctagatc

SEQ ID NO: 334155 - DNA, 631 bp, Homo sapiens
  misc_feature (10)..(10): n is a, c, g, or t
  misc_feature (15)..(15): n is a, c, g, or t
  misc_feature (583)..(583): n is a, c, g, or t
tccgcacaancatanggctaggtacgaggctgggtgttagtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccaaaaaaaaaaaaaaaaaaaaaaaacaaaacaaacaaacaaaaaaacaaaaaaaaaggggggggggggcaaaaaaaacccncagggggagaatacacaccccttgttataaagggcccccatgggggaa

SEQ ID NO: 334156 - DNA, 827 bp, Homo sapiens
  misc_feature (779)..(779): n is a, c, g, or t
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccaaaaaaaaaaaaaaaaaaaaaaaacaaaacaaacaaacaaaaaaacaaaaaaaaaggggggggggggcaaaaaaaacccncagggggagaatacacaccccttgttataaagggcccccatgggggaa

SEQ ID NO: 334157 - DNA, 879 bp, Homo sapiens
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagaccagaccaaaaaaaaaaacaagaaaaacaaccacagcaacacccaagacacaaccagaagacaaaaaaaagagcaaacacgaagagagggacacaacggagaccaacacgagcacgcgacaaaggagcaaatgcagcgacaaaaaggcgaacacaaaagagacgcaggccggtaacgagcacgaaac

SEQ ID NO: 334158 - DNA, 818 bp, Homo sapiens
gcctactactactaccactaaattcgcggccgcgtcgaccagggcggcgcgtggtctacgccgagtgacagagacgctcaggctgtgttctagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaaccttgggcagcccagaaaaaaaaaaaaaaaaaaaaaaaaccggggcactttgggggggggggaaaggggtaacgacgggactggctcagtgtcggacacttttggtcaagggggaaccggggcccccaaggggggagtacgaaaacggtacc

SEQ ID NO: 334159 - DNA, 880 bp, Homo sapiens
  misc_feature (832)..(832): n is a, c, g, or t
agggcaactacggggtagcggacatccgccaggcacgcttctagggccgcttctgcaactgcgcatgcgcttgggctgcacccattccgtctagcccaaaaggttcctctacaaccttcctccggattggtctatagggacacgatggccttttacgcaagcgtcacccgtgctgacccggaagttttcttcccagttaaaagtgttgggccgcggcgcgcggctcttcctgtctgtaccaggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccaaaaaaaaaaaaaaaaaaaaaaaacaaaacaaacaaacaaaaaaacaaaaaaaaaggggggggggggcaaaaaaaacccncagggggagaatacacaccccttgttataaagggcccccatgggggaa

SEQ ID NO: 334160 - DNA, 1185 bp, Homo sapiens
agggcaactacggggtagcggacatccgccaggcacgcttctagggccgcttctgcaactgcgcatgcgcttgggctgcacccattccgtctagcccaaaaggttcctctacaaccttcctccggattggtctatagggacacgatggccttttacgcaagcgtcacccgtgctgacccggaagttttcttcccagttaaaagtgttgggccgcggcgcgcggctcttcctgtctgtaccaggcggcgcgtggtctacgccgagtgacagagacgctcaggctgtgttctcaggatgaccgagtgggagacagcagcaccagcggtggcagagaccccagacccagacatcaagctctttgggaagtggagcaccgatgatgtgcagatcaatgacatttccctgcaggattacattgcagtgaaggagaagtatgccaagtacctgcctcagtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaaccggggcagcccagcaaaaaaaaaaaaaaaaaaaaaaaacaaaaaaaaaaaaaaaaacaaaacaaaaacccccgggcccctttttgggggggggggaaaaggggttaaaaaaggggcacaggggccaacgggtacccgaacccaaaaaaggaaacaggggggaaaaaacgggggcccccaaaaggggaggaggtcttaaaatccgcaaaaccgccgggtaaccggcgtatatggcagcctcccacacaaaccacacccacaaacaccaagcaaacacaacagcgcacactaagacaac

SEQ ID NO: 334161 - DNA, 981 bp, Homo sapiens
  misc_feature (941)..(941): n is a, c, g, or t
  misc_feature (967)..(967): n is a, c, g, or t
agggcaactacggggtagcggacatccgccaggcacgcttctagggccgcttctgcaactgcgcatgcgcttgggctgcacccattccgtctagcccaaaaggttcctctacaaccttcctccggattggtctatagggacacgatggccttttacgcaagcgtcacccgtgctgacccggaagttttcttcccagttaaaagtgttgggccgcggcgcgcggctcttcctgtctgtaccaggcggcgcgtggtctacgccgagtgacagagacgctcaggctgtgttctcaggatgaccgagtgggagacagcagcaccagcggtggcagagaccccagacccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgcatgttgttcccaggggcaaaattagncccgcccattagaactctggtcctgncctctcttggcagg

SEQ ID NO: 334162 - DNA, 751 bp, Homo sapiens
  misc_feature (703)..(703): n is a, c, g, or t
agggcaactacggggtagcggacatccgccaggcacgcttctagggccgcttctgcaactgcgcatgcgcttgggctgcacccattccgtctagcccaaaaggttcctctacaaccttcctccggattggtctatagggacacgatggccttttacgcaagcgtcacccgtgctgacccggaagttttcttcccagttaaaagtgttgggccgcggcgcgcggctcttcctgtctgtaccaggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccaaaaaaaaaaaaaaaaaaaaaaaacaaaacaaacaaacaaaaaaacaaaaaaaaaggggggggggggcaaaaaaaacccncagggggagaatacacaccccttgttataaagggcccccatgggggaa

SEQ ID NO: 334163 - DNA, 567 bp, Homo sapiens
  misc_feature (460)..(460): n is a, c, g, or t
agggcaactacggggtagcggacatccgccaggcacgcttctagggccgcttctgcaactgcgcatgcgcttgggctgcacccattccgtctagcccaaaaggttcctctacaaccttcctccggattggtctatagggacacgatggccttttacgcaagcgtcacccgtgctgacccggaagttttcttcccagttaaaagtgttgggccgcggcgcgcggctcttcctgtctgtaccaggcggcgcgtggtctacgccgagtgacagagacgctcaggctgtgttctcaggatgaccgagtgggagacagcagcaccagcggtggcagagaccccagacccagacatcaagctctttgggaagtggagcaccgatgatgtgcagatcaatgacatttccctgcaggattacattgcagtgaaggagaagtatgccaagtacctgcctcacgccaaangcttccgcaaagctcagtggggctttgtgccgcgcctaaagaaacgcccaatgatgcgcgttcgctgcccctaaaattagctcaagactcagcgatgagtatagctt

SEQ ID NO: 334164 - DNA, 1191 bp, Homo sapiens
aaaaccttacggctaggtacgaggcctgggtgtgagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagcaaaaaaacaaaaaaaaaacccttcacaatctgggcaagccaaaggccatttatccggggaaccattatcaggaaaaaaattctacctcttttatacttaatcttccctacatatttccccttttaatactaattagttcttatagaaagaacaaaccaacacaaacagccacaaaaaaaatcgacacaacaacacaacacaagaagtcaacccgaaaaacaaaacgcgaccagccaaaacagagaggaggggggcggcggcagataaaaaaagcaccaacgcggcgggggacacccaagagagcatacaccacaccagattgatgtaagcagaggaaggggccccacaaagggagcgggcacttaaataaaccaccacacgacggcgggagataaaaaaagaggcggcgtgagacacacacaacgtcacggagacatctgtaaaaagaacactctggcggggggaa

SEQ ID NO: 334165 - DNA, 404 bp, Homo sapiens
gcctactactactaccactaaattcgcggccgcgtcgaccagaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtcccaggggggacacatccacagcctgtcgtctcacagtcccggcgcgcccaatgcgtgtggagtcctcccgggggtcgacgcggccgcgaatttagtagtagtagtat

SEQ ID NO: 334166 - DNA, 1262 bp, Homo sapiens
  misc_feature (1078)..(1079): n is a, c, g, or t
  misc_feature (1103)..(1103): n is a, c, g, or t
  misc_feature (1115)..(1115): n is a, c, g, or t
  misc_feature (1238)..(1238): n is a, c, g, or t
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagcaaaaaaaaaaaaaaaaaaaaaagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaagttccgccatggagtcatagttgcagctgactccagggctacagcgggtgcttacattgcctcccagacggtgaagaaggtgatagagatcaacccatacctgctaggcaccatggctgnnggcgcagcggattgcagctctggngaacgctgtttngctcgcattgtcgaatctatgagcttcgaaataggaacgcatctctgtagcagctgccttcaaactgcttgcaacattgtgtatcagtacaaggcatgggcttgccatggcaccatgatctgngctgggataagaaaggcctgcctc

SEQ ID NO: 334167 - DNA, 913 bp, Homo sapiens
  misc_feature (865)..(865): n is a, c, g, or t
taggctacctccgcgctccacccagagacgggtcgcgctgctcccgccgccgcaaccccgggccctcgtgccggcggtctcccctcttccacgggcgagattactgcatagcacaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccaaaaaaaaaaaaaaaaaaaaaaaacaaaacaaacaaacaaaaaaacaaaaaaaaaggggggggggggcaaaaaaaacccncagggggagaatacacaccccttgttataaagggcccccatgggggaa

SEQ ID NO: 334168 - DNA, 777 bp, Homo sapiens
  misc_feature (54)..(54): n is a, c, g, or t
  misc_feature (86)..(86): n is a, c, g, or t
  misc_feature (729)..(729): n is a, c, g, or t
gcaccgatgatgtgcagatcaatggtgctccacttcccaaagagcttgatgtcnggggtctctgccaccgctggtgctgctgtctncaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccaaaaaaaaaaaaaaaaaaaaaaaacaaaacaaacaaacaaaaaaacaaaaaaaaaggggggggggggcaaaaaaaacccncagggggagaatacacaccccttgttataaagggcccccatgggggaa

SEQ ID NO: 334169 - DNA, 600 bp, Homo sapiens
  misc_feature (584)..(584): n is a, c, g, or t
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctgctcctggcacagcgctcgtgagatgcacaaaccngaagggtcctctagat

SEQ ID NO: 334170 - DNA, 601 bp, Homo sapiens
  misc_feature (553)..(553): n is a, c, g, or t
agagagagagagagagagagagagagagagagagagagagagagagagagagacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccaaaaaaaaaaaaaaaaaaaaaaaacaaaacaaacaaacaaaaaaacaaaaaaaaaggggggggggggcaaaaaaaacccncagggggagaatacacaccccttgttataaagggcccccatgggggaa

SEQ ID NO: 334171 - DNA, 932 bp, Homo sapiens
agggcaactacggggtagcggacatccgccaggcacgcttctagggccgcttctgcaactgcgcatgcgcttgggctgcacccattccgtctagcccaaaaggttcctctacaaccttcctccggattggtctatagggacacgatggccttttacgcaagcgtcacccgtgctgacccggaagttttcttcccagttaaaagtgttgggccgcggcgcgcggctcttcctgtctgtaccaggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcagggaaatgtcattgatcagcagcaccagcggtgcccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgcacttacgcgcgtaaggaccgggatcctctagatc

SEQ ID NO: 334172 - DNA, 912 bp, Homo sapiens
agggcaactacggggtagcggacatccgccaggcacgcttctagggccgcttctgcaactgcgcatgcgcttgggctgcacccattccgtctagcccaaaaggttcctctacaaccttcctccggattggtctatagggacacgatggccttttacgcaagcgtcacccgtgctgacccggaagttttcttcccagttaaaagtgttgggccgcggcgcgcggctcttcctgtctgtaccaggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggtgaggggaacttggtgattggccttcctggctgggggcggacattattccaggaaggcacacatcaaacttgttgctgtgccattaagtcaagaatagagatcataacaggtaaagaagggatcccttgaccaccacatctaccacatctgctcttacgtcctgttcaaagatgactacaacttctgtcatgagaggactccttcaccagaaggagcatcacatctcacatatggtatttttgttactgtttttggcgcacacaccataccatccagcgtcactccttctccacgtcactaccctccttttccagtacccatttcctcaccgagggcctctttctccttacatagacacggcctccggcccacttgccatcccccctcccggtctcgcgctcctctcgcatcttctctcccccttgtcttcctgccctcatcctcctcgccgcctctcgtcccttcctcctcccctgcccctactctccccgcgccctgtcctcctccg

SEQ ID NO: 334173 - DNA, 930 bp, Homo sapiens
  misc_feature (22)..(22): n is a, c, g, or t
  misc_feature (29)..(29): n is a, c, g, or t
  misc_feature (35)..(35): n is a, c, g, or t
  misc_feature (830)..(830): n is a, c, g, or t
  misc_feature (840)..(840): n is a, c, g, or t
  misc_feature (843)..(843): n is a, c, g, or t
taaactacggctaggaggaggncggtgtnatcggncgaggccaggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagcaaaaaaaaacacaacaaaaaaccacaccaacaaacaccaaacaacaaaaaaaagggggggggcgaanataccggggnccnaacgcccccttttggaggggccagagggcaaaacagcagcggggaaaggggggacgcgtggttggggacctcggggcgggcacccag

SEQ ID NO: 334174 - DNA, 929 bp, Homo sapiens
  misc_feature (829)..(829): n is a, c, g, or t
  misc_feature (839)..(839): n is a, c, g, or t
  misc_feature (842)..(842): n is a, c, g, or t
gcctactactactaccactaaattcgcggccgcgtcgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagcaaaaaaaaacacaacaaaaaaccacaccaacaaacaccaaacaacaaaaaaaagggggggggcgaanataccggggnccnaacgcccccttttggaggggccagagggcaaaacagcagcggggaaaggggggacgcgtggttggggacctcggggcgggcacccag

SEQ ID NO: 334175 - DNA, 869 bp, Homo sapiens
tgtggatggtctggtcgggaaaataaaccgttcgttgcggcacggcgggggctttggtgtgtctaaatacaactgtaaatacagctatgatgtacctaaatgaagaagaagaagaagaggaagaagcagaaaaagaagcagaagcagcagcagcagcagcagcggcagaagaagaagaagaagaagaggaaagaggaagaaattttaccaaaaatttgaaatattttaaaatattttccctcctttgttttgtcacaggcaagtcctggaaatgtgaacctctcatattttatcacacacttttgattattgtactagccagtcaagaacattagaaaaggcattaagaaattgatagaatattatgttcctgaataagatgacataatataaaaatgttaatttcctataaaactccatacaaatttaaatttattcaatttaaaactttgatgggaaaattgaaacttggcaaaagtattctgacatcattttagagaataaatgaggagagctgaggagtttttaaaagaaaaataattagaggaagttgatctgcaagacaatgaaatgttttataggttaaaataaattaaagcagtgttttactggcccaaatatattaaagcagactggtagaataaagtaaaaaacaagaaatcagacttactatttcttcagtacatagctcttgcactcctaggaaaatgctaagctacaaataaaacttaactgagtatttacaggatactcaaatacactaggaacaagatgagatcccttctccctaatactattagtaaatgcttttataaaatatatttcgttcttcagtatcttgagcatgttttattttttaataaaatgat

SEQ ID NO: 334176 - DNA, 802 bp, Homo sapiens
tactaatcttattattaataggtgtgtctaaatacaactgtaaatacagctatgatgtacctaaatgaagaagaagaagaagaggaagaagcagaaaaagaagcagaagcagcagcagcagcagcagcggcagaagaagaagaagaagaagaggaaagaggaagaaattttaccaaaaatttgaaatattttaaaatattttccctcctttgttttgtcacaggcaagtcctggaaatgtgaacctctcatattttatcacacacttttgattattgtactagccagtcaagaacattagaaaaggcattaagaaattgatagaatattatgttcctgaataagatgacataatataaaaatgttaatttcctataaaactccatacaaatttaaatttattcaatttaaaactttgatgggaaaattgaaacttggcaaaagtattctgacatcattttagagaataaatgaggagagctgaggagtttttaaaagaaaaataattagaggaagttgatctgcaagacaatgaaatgttttataggttaaaataaattaaagcagtgttttactggcccaaatatattaaagcagactggtagaataaagtaaaaaacaagaaatcagacttactatttcttcagtacatagctcttgcactcctaggaaaatgctaagctacaaataaaacttaactgagtatttacaggatactcaaatacactaggaacaagatgagatcccttctccctaatactattagtaaatgcttttataaaatatatttcgttcttcagtat

SEQ ID NO: 334177 - DNA, 334 bp, Homo sapiens
gcccttctgagctctttctacccagctccctctgccgggtgactggaagtcctgggtggcctggagggctcctgggggagctgtggtttgctgctgagcctgttgtctgctcatctcctcaggtgtgtggttgtgttgttcaatccccggaaacacaaacagcaccacatcctcaacagttccaggaaaaccatcactgcccttgccttctcccctgatggcaagtacttggtcactggagaggtgagtgaggaagagggctggcagtactgtaaagagggcaggtgtcctggcctccgcagagagctgcggtcctaggcctgctgtcactttg

SEQ ID NO: 334178 - DNA, 6896 bp, Homo sapiens
cgcgtcggctccgcccacccagcccgcggcttggcccaggcggtagttcgcgttttgagccgatcgtgccaccatagctcctgctgctgcctctaccgctgcggctaccgcggcggagctgaaattgccgaacgcgatgcccgagggcgctgtgagcggggtggccttagctcgccgaggctggtcagtgagagggcatactgggaagccctctggagtgggaagacagtgccgctgttgagacaagacccaggactgggccggggactgtcccaaagggtttctcgtcataatggctgtggaagggtcaaccattaccagccggatcaagaatctgttgagatctccatccatcaaactgcgcaggagtaaggcaggaaaccgacgagaggacctcagctccaaggtgaccttggagaaggtgctgggaattacagtgtctggaggcagaggacttgcctgtgacccccgatcaggtttagttgcttacccagcagggtgtgtggttgtgttgttcaatccccggaaacacaaacagcaccacatcctcaacagttccaggaaaaccatcactgcccttgccttctcccctgatggcaagtacttggtcactggagagagtgggcacatgcctgccgtgcgggtatgggacgtggcagagcacagccaggtggcgagctgcaggagcacaagtatggtgtggcttgtgtggccttctctcctagcgccaagtacattgtctctgtgggctaccagcatgacatgatcgtcaacgtgtgggcctggaagaaaaacattgtggtggcctccaacaaggtgtccagtcgggtgacagcagtgtccttctctgaggattgcagctactttgtcactgcaggcaaccgacacatcaaattctggtatctcgatgacagcaagacctcaaaggtgaatgccactgtgcccttgctgggccgctcagggctgctgggagagctacggaacaacctattcactgatgtggcctgtggcagaggaaaaaaggcggacagtaccttctgcatcacgtcctcagggctgctgtgcgagttcagtgatcgaaggcttttggacaagtgggtggagctgagggtctaccccgaggtgaaggatagtaaccaggcctgcctgccccccagttcctttattacctgctcctcagacaacaccatccgcctgtggaacacagagagctccggggtgcatggctccaccctccaccgaaacatcctcagcagtgacctcattaaaatcatctatgtggatgggaacacccaggccctgctggacacagagctgcctggaggagacaaagctgatgcatccctgttggatccccgcgtgggcatccgctcggtgtgtgtcagccccaatggacagcatctagcatcaggggaccgtatgggcacacttagggtgcacgaacttcagtccctgagtgagatgctgaaggtggaggcccatgactctgagattctgtgcctggagtattctaagccagacacaggtctgaaactgctagcatcggcgagccgggaccggctgatccatgtgctggatgccgggcgggagtacagcctacagcagacgctggacgaacactcatcctccatcactgctgtcaagtttgcagccagtgatgggcaagtccgcatgatcagctgtggagcagacaagagcatctacttccgcactgcgcagaagtctggagatggagtgcagttcacacggacacaccacgtggtgcggaagacgaccctctatgacatggatgtggagcccagctggaagtacacggctatcggctgccaggaccgaaatattcggatatttaacatcagcagtggaaagcagaagaagctgtttaaagggtcacagggtgaggacggcacactcattaaggtgcagacagacccctcagggatctacattgccaccagctgttctgacaagaatctctccatttttgacttctcctcaggcgagtgcgtggccaccatgtttggccactcagagattgtcactggcatgaaatttagtaatgattgtaaacatctcatctctgtgtctggggacagctgcatatttgtgtggcgcctgagctctgagatgaccatcagcatgaggcagcgtctggccgagttgcgccagcgtcagcggggcggcaagcagcaaggaccatcctctccccaaagggcttctggacccaaccggcaccaggccccatcaatgctgtctcctggaccggctctctcatcagacagtgacaaggagggagaagatgaggggactgaagaagaacttccagcactgcccgtccttgccaagagtaccaagaaggcactggcctcggtccccagcccagctttgccccgaagcctgtcccactgggagatgagtcgggcacaggagtccgtggggttcctggacccagctcctgcagccaacccaggacccagaagaagagggcgctgggttcagccaggtgtggaactgagcgttagatccatgctggatctgcggcagctggaaacactggccccaagcctgcaggaccctagccaggactcgctggccatcatcccatctggtcccaggaagcatgggcaggaggcccttgagacttcactcactagccagaatgaaaagccccctcggcctcaggcttcccaaccttgttcctatccccatattatccgattattgtcacaagaggaaggggtctttgcccaagatctggaacctgcacccattgaagatggtattgtctacccggagccgagtgacaaccccaccatggataccagtgagttccaagtgcaggctccagcccggggaactctgggaagagtgtacccaggcagcaggagctcagaaaagcacagccctgacagtgcctgctctgtggattacagcagcagctgcctttccagcccggagcaccccactgaagactctgagagcacggagcccctcagtgtggatggcatctcctcagaccttgaagagccagctgagggtgatgaagaagaggaagaagaggagggaggcatgggcccctatgggctacaggagggcagcccccagactccagaccaggagcagtttctaaaacagcactttgagactctggccagtggagctgctccaggggccccagtgcaggtcccagagaggtcagagtctcggagtatctcttcacgattcctgttgcaagtacagacccgcccactcagggaaccatccccatcctcctcaagcctggcactgatgtcgagaccagcccaggtgccacaggcatctggtgagcagccgagaggcaatggtgccaatccccctggagcacccccggaggtggaaccgtcctctggcaaccccagcccccagcaggcagcctctgtgctgttgccacgatgccgtctcaaccctgacagcagctgggctcccaagagagtggccacagccagccccttttctggactccagaaggcccagtctgtgcacagtctggtgccacaggaaagacatgaggccagtctgcaggccccttcaccaggcgcactgctgtctcgggagatcgaagctcaggatggtctgggctccctgcccccagctgatggccgtccgtctcggcctcactcctatcagaaccccaccaccagttccatggccaagatatcccgcagtatctctgttggggagaacctgggcctggtggctgaacctcaagctcatgcccccatccgagtctcaccactcagcaagctggccctgcccagccgggctcacctggtcctggacatccccaaaccactgcctgaccgtcctaccctggctgcattctctcctgtcaccaaaggccgggcccctggcgaggcagaaaagcctggcttcccggtgggcctaggaaaagctcacagtacaactgagagatgggcctgtttgggggagggcaccactcccaagcctaggacagagtgccaggctcatcctgggcccagcagcccctgtgcccagcaactgccagtcagcagcctcttccaaggccctgaaaacttgcagcccccaccccctgagaagactcccaaccccatggaatgcaccaagccaggggcagccctgagccaggactcagagccagcggtgagcctggagcagtgtgagcagctggtggcagagctccgcggcagcgtgcgccaggcagtgcggctctaccactcggtggctggctgcaagatgccctcagcagagcaaagtcggattgcccagctcctcagagacaccttctcttcagtgcgacaggagctggaagctgtggctggggcagtgctgtccagcccaggcagcagccctggggctgtgggagccgagcagacacaggccctgctggagcaatactcagaactgttgcttcgagccgtggaacggcgtatggaacgcaaactctgagttctggaagcctgtcccaagtgaatgaatgctccagcgattccaaactgcagcccctctgcccctcaccaaaacctgcggggctgcttggagtggaaagcagggagcagtgttcagaggcaaagcagccttcccagccgctcctcgtggggggcctgtatttattaatttatttccctgactgttgcctcacttccttggaactcctgcctccacagcccctccagtggcagggacaggtcttgggtctttgtcatcttggtgctgtgagaggtaggagggcagcctgccccatctaggaatctgggaagggctggccctctcttagaagccatttgaaattactgcagggattagctccctgtggtggagcatacacagggtactctggggtcgaggtgagaggtgatgtggtattcagtgcccgtcagccaactgtgggccttcacctctacctgcacttcccctctcacaccagctgcactcccgtggctgccagagcagggtggttttccccaatacctggagctcagaaaggcagagccatctggccctccagggtgtccccagccatcaggagacttgagttggtatttggacctgagcccgcacattccactcccattctccctccaagaggggcccagcattgtatttccctgtgaccccttactctcctggccagaacttgagccagctgtgggatgttgctgcaggacagtaagccctcacctgggcaaacatgaagctctggcctcctttcctcagccccttgttcttccctgtcctccaccctggaccccagccggctgctggagcccagaggccaccttctccctgcatcctgaatgatgcttagtcagaagcctgtgttggaacatccctcgtttacggggcgctggcctacctcctgaggacctcagccacagatgagatcacacgcatgcacgtgcacacatgtacacacacacacctacctgcacagcacgctgttgagtgttggttgctagagtatccggctggctgctgtgtgcctggtttcctcacatcctgcctcagcttcaccaccctggcttatgtggaacacctatcagggagcagaaaaggggtgcagtacactaagtgaacccagattctggattcttggtgtccacagcctagctgatacgagatagcccataggacacctggtttaggtagaaggagcctcctcaaaggcagtgctgggcacccacgggtgtgctggatactggagtttgagaggagggaggtgctggggccaaaggagacactagaaaagtggtagatgggacaggtaagtggcagaggtgaggggataagttagaatgtaaaagggcagtaattaggggtgagggaaaggagataggggaccctaggaggtagagtgggaccatgtcgtgaggcagttgaagagttgaggaaaggtttttctgggccctactgctcccctctgctgcaggtaagtcagagcagctttaccacagcttcaggccacgagagccccttcacccgccctgctgcgccataggcagaggcttataaagaaatgggttctgggccaggtgtggtggctcaagcctgtaatcccagcactttgggaggccgaggcgggtggatcacctgaggttaggagttcgagatcagcctggccaacatggtgaaaccctgtctctactaaaaataaaaaaattagctgggcgtggtggtgggcgcctgtaatcccagctactcgggaggtttaggcaggagaatcgcttgaaccctggaggtggaggtggaggttgcagtgagccgagatcgcgccattgcactccaacctaggtgacaaagctacacgccatctcaaaaaaaaaaaagaaaaagggttacaaaaggttcccagctccggggcatcagcctgagtgcgcttgagctgctccaaacctggcccttccccactcctctagcatcgccacccgcatggccctggaactcccgcggcggcgggggcgggcccgtgcctgctgtgccccgacttcccacaccagccgcgcccaccgcaggtgggactcaggttcgccctctgggccaggtccttcacgaggagggagctacccttcgccagaagtttgtgagaatgtggccgcccttttcctgccctctgccccatgtgggtggggggcctcgtggcccggccggcgccccgtccccttctgcatgtctgaggccaccggcaaccgccgccccactccagatttgcccccgccctgttttgaaagccccttatttataacttttatactttgtgcaggtcgcggcgcttcctgcctcatcctcggctgcatggggcgggggcgctgtttttaacgtgcccgtttgtactgatgtatgaacttgtcaataaacacaattgtttgttaaccctggga

SEQ ID NO: 334179 - DNA, 6865 bp, Homo sapiens
cgcgtcggctccgcccacccagcccgcggcttggcccaggcggtagttcgcgttttgagccgatcgtgccaccatagctcctgctgctgcctctaccgctgcggctaccgcggcggagctgaaattgccgaacgcgatgcccgagggcgctgtgagcggggtggccttagctcgccgaggctggtcagtgagagggcatactgggaagccctctggagtgggaagacagtgccgctgttgagacaagacccaggactgggccggggactgtcccaaagggtttctcgtcataatggctgtggaagggtcaaccattaccagccggatcaagaatctgttgagatctccatccatcaaactgcgcaggagtaaggcaggaaaccgacgagaggacctcagctccaaggtgaccttggagaaggtgctgggaattacagtgtctggaggcagaggacttgcctgtgacccccgatcaggtttagttgcttacccagcagggtgtgtggttgtgttgttcaatccccggaaacacaaacagcaccacatcctcaacagttccaggaaaaccatcactgcccttgccttctcccctgatggcaagtacttggtcactggagagagtgggcacatgcctgccgtgcgggtatgggacgtggcagagcacagccaggtggcgagctgcaggagcacaagtatggtgtggcttgtgtggccttctctcctagcgccaagtacattgtctctgtgggctaccagcatgacatgatcgtcaacgtgtgggcctggaagaaaaacattgtggtggcctccaacaaggtgtccagtcgggtgacagcagtgtccttctctgaggattgcagctactttgtcactgcaggcaaccgacacatcaaattctggtatctcgatgacagcaagacctcaaaggtgaatgccactgtgcccttgctgggccgctcagggctgctgggagagctacggaacaacctattcactgatgtggcctgtggcagaggaaaaaaggcggacagtaccttctgcatcacgtcctcagggctgctgtgcgagttcagtgatcgaaggcttttggacaagtgggtggagctgagggtctaccccgaggtgaaggatagtaaccaggcctgcctgccccccagttcctttattacctgctcctcagacaacaccatccgcctgtggaacacagagagctccggggtgcatggctccaccctccaccgaaacatcctcagcagtgacctcattaaaatcatctatgtggatgggaacacccaggccctgctggacacagagctgcctggaggagacaaagctgatgcatccctgttggatccccgcgtgggcatccgctcggtgtgtgtcagccccaatggacagcatctagcatcaggggaccgtatgggcacacttagggtgcacgaacttcagtccctgagtgagatgctgaaggtggaggcccatgactctgagattctgtgcctggagtattctaagccagacacaggtctgaaactgctagcatcggcgagccgggaccggctgatccatgtgctggatgccgggcgggagtacagcctacagcagacgctggacgaacactcatcctccatcactgctgtcaagtttgcagccagtgatgggcaagtccgcatgatcagctgtggagcagacaagagcatctacttccgcactgcgcagaagtctggagatggagtgcagttcacacggacacaccacgtggtgcggaagacgaccctctatgacatggatgtggagcccagctggaagtacacggctatcggctgccaggaccgaaatattcggatatttaacatcagcagtggaaagcagaagaagctgtttaaagggtcacagggtgaggacggcacactcattaaggtgcagacagacccctcagggatctacattgccaccagctgttctgacaagaatctctccatttttgacttctcctcaggcgagtgcgtggccaccatgtttggccactcagagattgtcactggcatgaaatttagtaatgattgtaaacatctcatctctgtgtctggggacagctgcatatttgtgtggcgcctgagctctgagatgaccatcagcatgaggcagcgtctggccgagttgcgccagcgtcagcggggcggcaagcagcaaggaccatcctctccccaaagggcttctggacccaaccggcaccaggccccatcaatgctgtctcctggaccggctctctcatcagacagtgacaaggagggagaagatgaggggactgaagaagaacttccagcactgcccgtccttgccaagagtaccaagaaggcactggcctcggtccccagcccagctttgccccgaagcctgtcccactgggagatgagtcgggcacaggagtccgtggggttcctggacccagctcctgcagccaacccaggacccagaagaagagggcgctgggttcagccaggtgtggaactgagcgttagatccatgctggatctgcggcagctggaaacactggccccaagcctgcaggaccctagccaggactcgctggccatcatcccatctggtcccaggaagcatgggcaggaggcccttgagacttcactcactagccagaatgaaaagccccctcggcctcaggcttcccaaccttgttcctatccccatattatccgattattgtcacaagaggaaggggtctttgcccaagatctggaacctgcacccattgaagatggtattgtctacccggagccgagtgacaaccccaccatggataccagtgagttccaagtgcaggctccagcccggggaactctgggaagagtgtacccaggcagcaggagctcagaaaagcacagccctgacagtgcctgctctgtggattacagcagcagctgcctttccagcccggagcaccccactgaagactctgagagcacggagcccctcagtgtggatggcatctcctcagaccttgaagagccagctgagggtgatgaagaagaggaagaagaggagggaggcatgggcccctatgggctacaggagggcagcccccagactccagaccaggagcagtttctaaaacagcactttgagactctggccagtggagctgctccaggggccccagtgcaggtcccagagaggtcagagtctcggagtatctcttcacgattcctgttgcaagtacagacccgcccactcagggaaccatccccatcctcctcaagcctggcactgatgtcgagaccagcccaggtgccacaggcatctggtgagcagccgagaggcaatggtgccaatccccctggagcacccccggaggtggaaccgtcctctggcaaccccagcccccagcaggcagcctctgtgctgttgccacgatgccgtctcaaccctgacagcagctgggctcccaagagagtggccacagccagccccttttctggactccagaaggcccagtctgtgcacagtctggtgccacaggaaagacatgaggccagtctgcaggccccttcaccaggcgcactgctgtctcgggagatcgaagctcaggatggtctgggctccctgcccccagctgatggccgtccgtctcggcctcactcctatcagaaccccaccaccagttccatggccaagatatcccgcagtatctctgttggggagaacctgggcctggtggctgaacctcaagctcatgcccccatccgagtctcaccactcagcaagctggccctgcccagccgggctcacctggtcctggacatccccaaaccactgcctgaccgtcctaccctggctgcattctctcctgtcaccaaaggccgggcccctggcgaggcagaaaagcctggcttcccggtgggcctaggaaaagctcacagtacaactgagagatgggcctgtttgggggagggcaccactcccaagcctaggacagagtgccaggctcatcctgggcccagcagcccctgtgcccagcaactgccagtcagcagcctcttccaaggccctgaaaacttgcagcccccaccccctgagaagactcccaaccccatggaatgcaccaagccaggggcagccctgagccaggactcagagccagcggtgagcctggagcagtgtgagcagctggtggcagagctccgcggcagcgtgcgccaggcagtgcggctctaccactcggtggctggctgcaagatgccctcagcagagcaaagtcggattgcccagctcctcagagacaccttctcttcagtgcgacaggagctggaagctgtggctggggcagtgctgtccagcccaggcagcagccctggggctgtgggagccgagcagacacaggccctgctggagcaatactcagaactgttgcttcgagccgtggaacggcgtatggaacgcaaactctgagttctggaagcctgtcccaagtgaatgaatgctccagcgattccaaactgcagcccctctgcccctcaccaaaacctgcggggctgcttggagtggaaagcagggagcagtgttcagaggcaaagcagccttcccagccgctcctcgtggggggcctgtatttattaatttatttccctgactgttgcctcacttccttggaactcctgcctccacagcccctccagtggcagggacaggtcttgggtctttgtcatcttggtgctgtgagaggtaggagggcagcctgccccatctaggaatctgggaagggctggccctctcttagaagccatttgaaattactgcagggattagctccctgtggtggagcatacacagggtactctggggtcgaggtgagaggtgatgtggtattcagtgcccgtcagccaactgtgggccttcacctctacctgcacttcccctctcacaccagctgcactcccgtggctgccagagcagggtggttttccccaatacctggagctcagaaaggcagagccatctggccctccagggtgtccccagccatcaggagacttgagttggtatttggacctgagcccgcacattccactcccattctccctccaagaggggcccagcattgtatttccctgtgaccccttactctcctggccagaacttgagccagctgtgggatgttgctgcaggacagtaagccctcacctgggcaaacatgaagctctggcctcctttcctcagccccttgttcttccctgtcctccaccctggaccccagccggctgctggagcccagaggccaccttctccctgcatcctgaatgatgcttagtcagaagcctgtgttggaacatccctcgtttacggggcgctggcctacctcctgaggacctcagccacagatgagatcacacgcatgcacgtgcacacatgtacacacacacacctacctgcacagcacgctgttgagtgttggttgctagagtatccggctggctgctgtgtgcctggtttcctcacatcctgcctcagcttcaccaccctggcttatgtggaacacctatcagggagcagaaaaggggtgcagtacactaagtgaacccagattctggattcttggtgtccacagcctagctgatacgagatagcccataggacacctggtttaggtagaaggagcctcctcaaaggcagtgctgggcacccacgggtgtgctggatactggagtttgagaggagggaggtgctggggccaaaggagacactagaaaagtggtagatgggacaggtaagtggcagaggtgaggggataagttagaatgtaaaagggcagtaattaggggtgagggaaaggagataggggaccctaggaggtagagtgggaccatgtcgtgaggcagttgaagagttgaggaaaggtttttctgggccctactgctcccctctgctgcaggtaagtcagagcagctttaccacagcttcaggccacgagagccccttcacccgccctgctgcgccataggcagaggcttataaagaaatgggttctgggccaggtgtggtggctcaagcctgtaatcccagcactttgggaggccgaggcgggtggatcacctgaggttaggagttcgagatcagcctggccaacatggtgaaaccctgtctctactaaaaataaaaaaattagctgggcgtggtggtgggcgcctgtaaatcgcttgaaccctggaggtggaggtggaggttgcagtgagccgagatcgcgccattgcactccaacctaggtgacaaagctacacgccatctcaaaaaaaaaaaagaaaaagggttacaaaaggttcccagctccggggcatcagcctgagtgcgcttgagctgctccaaacctggcccttccccactcctctagcatcgccacccgcatggccctggaactcccgcggcggcgggggcgggcccgtgcctgctgtgccccgacttcccacaccagccgcgcccaccgcaggtgggactcaggttcgccctctgggccaggtccttcacgaggagggagctacccttcgccagaagtttgtgagaatgtggccgcccttttcctgccctctgccccatgtgggtggggggcctcgtggcccggccggcgccccgtccccttctgcatgtctgaggccaccggcaaccgccgccccactccagatttgcccccgccctgttttgaaagccccttatttataacttttatactttgtgcaggtcgcggcgcttcctgcctcatcctcggctgcatggggcgggggcgctgtttttaacgtgcccgtttgtactgatgtatgaacttgtcaataaacacaattgtttgttaaccctggga

SEQ ID NO: 334180 - DNA, 4603 bp, Homo sapiens
tcagctgcctggtgcctggaagtaaatatcatcagagaagagctcaaggtggagaggacaaaggacccctaagccagatagttagaactaaaatgcaggaaatcaaggatccaaagagcggagatctggagaaacagttctaaagatcccggttaggaggcacaggagtccgtggggttcctggacccagctcctgcagccaacccaggacccagaagaagagggcgctgggttcagccaggtgtggaactgagcgttagatccatgctggatctgcggcagctggaaacactggccccaagcctgcaggaccctagccaggactcgctggccatcatcccatctggtcccaggaagcatgggcaggaggcccttgagacttcactcactagccagaatgaaaagccccctcggcctcaggcttcccaaccttgttcctatccccatattatccgattattgtcacaagaggaaggggtctttgcccaagatctggaacctgcacccattgaagatggtattgtctacccggagccgagtgacaaccccaccatggataccagtgagttccaagtgcaggctccagcccggggaactctgggaagagtgtacccaggcagcaggagctcagaaaagcacagccctgacagtgcctgctctgtggattacagcagcagctgcctttccagcccggagcaccccactgaagactctgagagcacggagcccctcagtgtggatggcatctcctcagaccttgaagagccagctgagggtgatgaagaagaggaagaagaggagggaggcatgggcccctatgggctacaggagggcagcccccagactccagaccaggagcagtttctaaaacagcactttgagactctggccagtggagctgctccaggggccccagtgcaggtcccagagaggtcagagtctcggagtatctcttcacgattcctgttgcaagtacagacccgcccactcagggaaccatccccatcctcctcaagcctggcactgatgtcgagaccagcccaggtgccacaggcatctggtgagcagccgagaggcaatggtgccaatccccctggagcacccccggaggtggaaccgtcctctggcaaccccagcccccagcaggcagcctctgtgctgttgccacgatgccgtctcaaccctgacagcagctgggctcccaagagagtggccacagccagccccttttctggactccagaaggcccagtctgtgcacagtctggtgccacaggaaagacatgaggccagtctgcaggccccttcaccaggcgcactgctgtctcgggagatcgaagctcaggatggtctgggctccctgcccccagctgatggccgtccgtctcggcctcactcctatcagaaccccaccaccagttccatggccaagatatcccgcagtatctctgttggggagaacctgggcctggtggctgaacctcaagctcatgcccccatccgagtctcaccactcagcaagctggccctgcccagccgggctcacctggtcctggacatccccaaaccactgcctgaccgtcctaccctggctgcattctctcctgtcaccaaaggccgggcccctggcgaggcagaaaagcctggcttcccggtgggcctaggaaaagctcacagtacaactgagagatgggcctgtttgggggagggcaccactcccaagcctaggacagagtgccaggctcatcctgggcccagcagcccctgtgcccagcaactgccagtcagcagcctcttccaaggccctgaaaacttgcagcccccaccccctgagaagactcccaaccccatggaatgcaccaagccaggggcagccctgagccaggactcagagccagcggtgagcctggagcagtgtgagcagctggtggcagagctccgcggcagcgtgcgccaggcagtgcggctctaccactcggtggctggctgcaagatgccctcagcagagcaaagtcggattgcccagctcctcagagacaccttctcttcagtgcgacaggagctggaagctgtggctggggcagtgctgtccagcccaggcagcagccctggggctgtgggagccgagcagacacaggccctgctggagcaatactcagaactgttgcttcgagccgtggaacggcgtatggaacgcaaactctgagttctggaagcctgtcccaagtgaatgaatgctccagcgattccaaactgcagcccctctgcccctcaccaaaacctgcggggctgcttggagtggaaagcagggagcagtgttcagaggcaaagcagccttcccagccgctcctcgtggggggcctgtatttattaatttatttccctgactgttgcctcacttccttggaactcctgcctccacagcccctccagtggcagggacaggtcttgggtctttgtcatcttggtgctgtgagaggtaggagggcagcctgccccatctaggaatctgggaagggctggccctctcttagaagccatttgaaattactgcagggattagctccctgtggtggagcatacacagggtactctggggtcgaggtgagaggtgatgtggtattcagtgcccgtcagccaactgtgggccttcacctctacctgcacttcccctctcacaccagctgcactcccgtggctgccagagcagggtggttttccccaatacctggagctcagaaaggcagagccatctggccctccagggtgtccccagccatcaggagacttgagttggtatttggacctgagcccgcacattccactcccattctccctccaagaggggcccagcattgtatttccctgtgaccccttactctcctggccagaacttgagccagctgtgggatgttgctgcaggacagtaagccctcacctgggcaaacatgaagctctggcctcctttcctcagccccttgttcttccctgtcctccaccctggaccccagccggctgctggagcccagaggccaccttctccctgcatcctgaatgatgcttagtcagaagcctgtgttggaacatccctcgtttacggggcgctggcctacctcctgaggacctcagccacagatgagatcacacgcatgcacgtgcacacatgtacacacacacacctacctgcacagcacgctgttgagtgttggttgctagagtatccggctggctgctgtgtgcctggtttcctcacatcctgcctcagcttcaccaccctggcttatgtggaacacctatcagggagcagaaaaggggtgcagtacactaagtgaacccagattctggattcttggtgtccacagcctagctgatacgagatagcccataggacacctggtttaggtagaaggagcctcctcaaaggcagtgctgggcacccacgggtgtgctggatactggagtttgagaggagggaggtgctggggccaaaggagacactagaaaagtggtagatgggacaggtaagtggcagaggtgaggggataagttagaatgtaaaagggcagtaattaggggtgagggaaaggagataggggaccctaggaggtagagtgggaccatgtcgtgaggcagttgaagagttgaggaaaggtttttctgggccctactgctcccctctgctgcaggtaagtcagagcagctttaccacagcttcaggccacgagagccccttcacccgccctgctgcgccataggcagaggcttataaagaaatgggttctgggccaggtgtggtggctcaagcctgtaatcccagcactttgggaggccgaggcgggtggatcacctgaggttaggagttcgagatcagcctggccaacatggtgaaaccctgtctctactaaaaataaaaaaattagctgggcgtggtggtgggcgcctgtaaatcgcttgaaccctggaggtggaggtggaggttgcagtgagccgagatcgcgccattgcactccaacctaggtgacaaagctacacgccatctcaaaaaaaaaaaagaaaaagggttacaaaaggttcccagctccggggcatcagcctgagtgcgcttgagctgctccaaacctggcccttccccactcctctagcatcgccacccgcatggccctggaactcccgcggcggcgggggcgggcccgtgcctgctgtgccccgacttcccacaccagccgcgcccaccgcaggtgggactcaggttcgccctctgggccaggtccttcacgaggagggagctacccttcgccagaagtttgtgagaatgtggccgcccttttcctgccctctgccccatgtgggtggggggcctcgtggcccggccggcgccccgtccccttctgcatgtctgaggccaccggcaaccgccgccccactccagatttgcccccgccctgttttgaaagccccttatttataacttttatactttgtgcaggtcgcggcgcttcctgcctcatcctcggctgcatggggcgggggcgctgtttttaacgtgcccgtttgtactgatgtatgaacttgtcaataaacacaattgtttgttaaccctggga

SEQ ID NO: 334181 - DNA, 967 bp, Homo sapiens
cgcgtcggctccgcccacccagcccgcggcttggcccaggcggtagttcgcgttttgagccgatcgtgccaccatagctcctgctgctgcctctaccgctgcggctaccgcggcggagctgaaattgccgaacgcgatgcccgagggcgctgtgagcggggtggccttagctcgccgaggctggtcagtgagagggcatactgggaagccctctggagtgggaagacagtgccgctgttgagacaagacccaggactgggccggggactgtcccaaagggtttctcgtcataatggctgtggaagggtcaaccattaccagccggatcaagaatctgttgagatctccatccatcaaactgcgcaggagtaaggcaggaaaccgacgagaggacctcagctccaaggtgaccttggagaaggtgctgggaattacagtgtctggaggcagaggacttgcctgtgacccccgatcaggtttagttgcttacccagcagggtgtgtggttgtgttgttcaatccccggaaacacaaacagcaccacatcctcaacagttccaggaaaaccatcactgcccttgccttctcccctgatggcaagtacttggtcactggagagagtgggcacatgcctgccgtgcgggtatgggacgtggcagagcacagccaggtggcgagctgcaggagcacaagtatggtgtggcttgtgtggccttctctcctagcgccaagtacattgtctctgtgggctaccagcatgacatgatcgtcaacgtgtgggcctggaagaaaaacattgtggtggcctccaacaaggtgtccagtcgggtgacagcagtgtccttctctgaggattgcagctactttgtcactgcaggcaaccgacacatcaaattctggtatctcgatgacagcaagacctcaaaggtgaggtgctgaagctgggagtagccaccaaggcccctgg

SEQ ID NO: 334182 - DNA, 506 bp, Homo sapiens
atagaccgtattctttgctcttcacagagattgtcactggcatgaaatttagtaatgattgtaaacatctcatctctgtgtctggggacaggtgagcagaagccagcttccctgagaggcagattcttactctgccacagcaccctgccctcccctctctccatttcagtgatgtctctgggaagtggggttaacagggatagcttttggctgtgcttgacctgaagtggagggtggctctggtctccttgccatccatggataaggggaacgaatggcgctagccattctacctgcccctccttcagccaactgtgtggctttaccccagctgcatatttgtgtggcgcctgagctctgagatgaccatcagcatgaggcagcgtctggccgagttgcgccagcgtcagcggggcggcaagcagcaaggaccatcctctccccaaagggcttctggacccaaccggtgagaacagaatgtgggcaagtgatgggtgggtgtgcag

SEQ ID NO: 334183 - DNA, 734 bp, Homo sapiens
ctggaagtaaatatcatcagagaagagctcaaggtggagaggacaaaggacccctaagccagatagttagaactaaaatgcaggaaatcaaggatccaaagagcggagatctggagaaacagttctaaagatcccggttaggaggtaagcggagaacttccagaatagttagagggaaaaggccatgaggggacccataactcagcgactgccctggggtggccaaagggggatcaaggtgttcagagcaagttcccaagcaccagtaccttccgttgtcagcaacagtttcacagagtgatgatgctgtggtgtctctggagcaccctgaccgggccaggggtctcaggcctgggctataggtttgtccttggtgctgtgaggggactttggggcccccagctattggagtgattggggtagagaggcaaaaggagtggttggggtagacaggcagaagtggcctttgccctgggctggatttcttgggggactcttggtagtaagtggttgctgctggggctgtcctcagagtaggagacttttagagacccccagctctgaggcatccatgataccaggtgaaggctgagactaggggttcctgtgccagaggatgcggaatgcagctaagagcatgaactctggagccagactaatctgcaggccacttactgtctgtgggacgcagactgctcacttaagccccctgtgcttcagtctcctcatctgta

SEQ ID NO: 334184 - DNA, 376 bp, Homo sapiens
caggagtccgtggggttcctggacccagctcctgcagccaacccaggacccagaagaagagggcgctgggttcagccaggtgtggaactgagcgttagatccatgctggatctgcggcagctggaaacactggccccaagcctgcaggaccctagccaggactcgctggccatcatcccatctggtcccaggaagcatgggcaggaggcccttgagacttcactcactagccaggtgagcctgctttctcccagctctctagagagttccaaggggccttaggcagcctttgccaccagctgggacctgagcactggtccagctatgcttgctctgcccctgtggcacatgggtaacctgaactgcaaagccagga

SEQ ID NO: 334185 - DNA, 478 bp, Homo sapiens
actgtgtggctttaccccagctgcatatttgtgtggcgcctgagctctgagatgaccatcagcatgaggcagcgtctggccgagttgcgccagcgtcagcggggcggcaagcagcaaggaccatcctctccccaaagggcttctggacccaaccggcaccaggccccatcaatgctgtctcctggaccggctctctcatcagacagtgacaaggagggagaagatgaggggactgaagaagaacttccagcactgcccgtccttgccaagagtaccaagaaggcactggcctcggtccccagcccagctttgccccgaagcctgtcccactgggagatgagtcgggtgagtcgccattgttaaaatgttcttccaaggttagaggaggcaaagggagctgtgagaacagggctctctgggcctggtagggtactggggcatggggtctgcccacatgctgcactcgtgtgtccaagga

SEQ ID NO: 334186 - DNA, 5728 bp, Homo sapiens
caagaaaaaggacatagtaggaaaactggtgaaatttgaataaggtctctaattaatagtattataccaacataaatttcctagttttgataattgcactatcgttatgtaagatgttcacattagggaaagctgggtaagggaaatatagacgctctctgttctttcagcaacttttctctaagcctaaaagttcaaaaaaaggaaaaaggaggagaaaatgtagcagaggagggggcgtgagtccttcctgcggcctggccatggcctcttcccacctctcctcatctttgcagggtgcacgaacttcagtccctgagtgagatgctgaaggtggaggcccatgactctgagattctgtgcctggagtattctaagccagacacaggtctgaaactgctagcatcggcgagccgggaccggctgatccatgtgctggatgccgggcgggagtacagcctacagcagacgctggacgaacactcatcctccatcactgctgtcaagtttgcagccagtgatgggcaagtccgcatgatcagctgtggagcagacaagagcatctacttccgcactgcgcagaagtctggagatggagtgcagttcacacggacacaccacgtggtgcggaagacgaccctctatgacatggatgtggagcccagctggaagtacacggctatcggctgccaggaccgaaatattcggatatttaacatcagcagtggaaagcagaagaagctgtttaaagggtcacagggtgaggacggcacactcattaaggtgcagacagacccctcagggatctacattgccaccagctgttctgacaagaatctctccatttttgacttctcctcaggcgagtgcgtggccaccatgtttggccactcagagattgtcactggcatgaaatttagtaatgattgtaaacatctcatctctgtgtctggggacagctgcatatttgtgtggcgcctgagctctgagatgaccatcagcatgaggcagcgtctggccgagttgcgccagcgtcagcggggcggcaagcagcaaggaccatcctctccccaaagggcttctggacccaaccggcaccaggccccatcaatgctgtctcctggaccggctctctcatcagacagtgacaaggagggagaagatgaggggactgaagaagaacttccagcactgcccgtccttgccaagagtaccaagaaggcactggcctcggtccccagcccagctttgccccgaagcctgtcccactgggagatgagtcgggcacaggagtccgtggggttcctggacccagctcctgcagccaacccaggacccagaagaagagggcgctgggttcagccaggtgtggaactgagcgttagatccatgctggatctgcggcagctggaaacactggccccaagcctgcaggaccctagccaggactcgctggccatcatcccatctggtcccaggaagcatgggcaggaggcccttgagacttcactcactagccagaatgaaaagccccctcggcctcaggcttcccaaccttgttcctatccccatattatccgattattgtcacaagaggaaggggtctttgcccaagatctggaacctgcacccattgaagatggtattgtctacccggagccgagtgacaaccccaccatggataccagtgagttccaagtgcaggctccagcccggggaactctgggaagagtgtacccaggcagcaggagctcagaaaagcacagccctgacagtgcctgctctgtggattacagcagcagctgcctttccagcccggagcaccccactgaagactctgagagcacggagcccctcagtgtggatggcatctcctcagaccttgaagagccagctgagggtgatgaagaagaggaagaagaggagggaggcatgggcccctatgggctacaggagggcagcccccagactccagaccaggagcagtttctaaaacagcactttgagactctggccagtggagctgctccaggggccccagtgcaggtcccagagaggtcagagtctcggagtatctcttcacgattcctgttgcaagtacagacccgcccactcagggaaccatccccatcctcctcaagcctggcactgatgtcgagaccagcccaggtgccacaggcatctggtgagcagccgagaggcaatggtgccaatccccctggagcacccccggaggtggaaccgtcctctggcaaccccagcccccagcaggcagcctctgtgctgttgccacgatgccgtctcaaccctgacagcagctgggctcccaagagagtggccacagccagccccttttctggactccagaaggcccagtctgtgcacagtctggtgccacaggaaagacatgaggccagtctgcaggccccttcaccaggcgcactgctgtctcgggagatcgaagctcaggatggtctgggctccctgcccccagctgatggccgtccgtctcggcctcactcctatcagaaccccaccaccagttccatggccaagatatcccgcagtatctctgttggggagaacctgggcctggtggctgaacctcaagctcatgcccccatccgagtctcaccactcagcaagctggccctgcccagccgggctcacctggtcctggacatccccaaaccactgcctgaccgtcctaccctggctgcattctctcctgtcaccaaaggccgggcccctggcgaggcagaaaagcctggcttcccggtgggcctaggaaaagctcacagtacaactgagagatgggcctgtttgggggagggcaccactcccaagcctaggacagagtgccaggctcatcctgggcccagcagcccctgtgcccagcaactgccagtcagcagcctcttccaaggccctgaaaacttgcagcccccaccccctgagaagactcccaaccccatggaatgcaccaagccaggggcagccctgagccaggactcagagccagcggtgagcctggagcagtgtgagcagctggtggcagagctccgcggcagcgtgcgccaggcagtgcggctctaccactcggtggctggctgcaagatgccctcagcagagcaaagtcggattgcccagctcctcagagacaccttctcttcagtgcgacaggagctggaagctgtggctggggcagtgctgtccagcccaggcagcagccctggggctgtgggagccgagcagacacaggccctgctggagcaatactcagaactgttgcttcgagccgtggaacggcgtatggaacgcaaactctgagttctggaagcctgtcccaagtgaatgaatgctccagcgattccaaactgcagcccctctgcccctcaccaaaacctgcggggctgcttggagtggaaagcagggagcagtgttcagaggcaaagcagccttcccagccgctcctcgtggggggcctgtatttattaatttatttccctgactgttgcctcacttccttggaactcctgcctccacagcccctccagtggcagggacaggtcttgggtctttgtcatcttggtgctgtgagaggtaggagggcagcctgccccatctaggaatctgggaagggctggccctctcttagaagccatttgaaattactgcagggattagctccctgtggtggagcatacacagggtactctggggtcgaggtgagaggtgatgtggtattcagtgcccgtcagccaactgtgggccttcacctctacctgcacttcccctctcacaccagctgcactcccgtggctgccagagcagggtggttttccccaatacctggagctcagaaaggcagagccatctggccctccagggtgtccccagccatcaggagacttgagttggtatttggacctgagcccgcacattccactcccattctccctccaagaggggcccagcattgtatttccctgtgaccccttactctcctggccagaacttgagccagctgtgggatgttgctgcaggacagtaagccctcacctgggcaaacatgaagctctggcctcctttcctcagccccttgttcttccctgtcctccaccctggaccccagccggctgctggagcccagaggccaccttctccctgcatcctgaatgatgcttagtcagaagcctgtgttggaacatccctcgtttacggggcgctggcctacctcctgaggacctcagccacagatgagatcacacgcatgcacgtgcacacatgtacacacacacacctacctgcacagcacgctgttgagtgttggttgctagagtatccggctggctgctgtgtgcctggtttcctcacatcctgcctcagcttcaccaccctggcttatgtggaacacctatcagggagcagaaaaggggtgcagtacactaagtgaacccagattctggattcttggtgtccacagcctagctgatacgagatagcccataggacacctggtttaggtagaaggagcctcctcaaaggcagtgctgggcacccacgggtgtgctggatactggagtttgagaggagggaggtgctggggccaaaggagacactagaaaagtggtagatgggacaggtaagtggcagaggtgaggggataagttagaatgtaaaagggcagtaattaggggtgagggaaaggagataggggaccctaggaggtagagtgggaccatgtcgtgaggcagttgaagagttgaggaaaggtttttctgggccctactgctcccctctgctgcaggtaagtcagagcagctttaccacagcttcaggccacgagagccccttcacccgccctgctgcgccataggcagaggcttataaagaaatgggttctgggccaggtgtggtggctcaagcctgtaatcccagcactttgggaggccgaggcgggtggatcacctgaggttaggagttcgagatcagcctggccaacatggtgaaaccctgtctctactaaaaataaaaaaattagctgggcgtggtggtgggcgcctgtaaatcgcttgaaccctggaggtggaggtggaggttgcagtgagccgagatcgcgccattgcactccaacctaggtgacaaagctacacgccatctcaaaaaaaaaaaagaaaaagggttacaaaaggttcccagctccggggcatcagcctgagtgcgcttgagctgctccaaacctggcccttccccactcctctagcatcgccacccgcatggccctggaactcccgcggcggcgggggcgggcccgtgcctgctgtgccccgacttcccacaccagccgcgcccaccgcaggtgggactcaggttcgccctctgggccaggtccttcacgaggagggagctacccttcgccagaagtttgtgagaatgtggccgcccttttcctgccctctgccccatgtgggtggggggcctcgtggcccggccggcgccccgtccccttctgcatgtctgaggccaccggcaaccgccgccccactccagatttgcccccgccctgttttgaaagccccttatttataacttttatactttgtgcaggtcgcggcgcttcctgcctcatcctcggctgcatggggcgggggcgctgtttttaacgtgcccgtttgtactgatgtatgaacttgtcaataaacacaattgtttgttaaccctggga

SEQ ID NO: 334187 - DNA, 5577 bp, Homo sapiens
cgcgtcggctccgcccacccagcccgcggcttggcccaggcggtagttcgcgttttgagccgatcgtgccaccatagctcctgctgctgcctctaccgctgcggctaccgcggcggagctgaaattgccgaacgcgatgcccgagggcgctgtgagcggggtggccttagctcgccgaggctggtcagtgagagggcatactgggaagccctctggagtgggaagacagtgccgctgttgagacaagacccaggactgggccggggactgtcccaaagggtttctcgtcataatggctgtggaagggtcaaccattaccagccggatcaagaatctgttgagatctccatccatcaaactgcgcaggagtaaggcaggaaaccgacgagaggacctcagctccaaggtgaccttggagaaggtgctgggaattacagtgtctggaggcagaggacttgcctgtgacccccgatcaggtttagttgcttacccagcagggtgtgtggttgtgttgttcaatccccggaaacacaaacagcaccacatcctcaacagttccaggaaaaccatcactgcccttgccttctcccctgatggcaagtacttggtcactggagagagtgggcacatgcctgccgtgcgggtatgggacgtggcagagcacagccaggtggcgagctgcaggagcacaagtatggtgtggcttgtgtggccttctctcctagcgccaagtacattgtctctgtgggctaccagcatgacatgatcgtcaacgtgtgggcctggaagaaaaacattgtggtggcctccaacaaggtgtccagtcgggtgacagcagtgtccttctctgaggattgcagctactttgtcactgcaggcaaccgacacatcaaattctggtatctcgatgacagcaagacctcaaaggtgaatgccactgtgcccttgctgggccgctcagggctgctgggagagctacggaacaacctattcactgatgtggcctgtggcagaggaaaaaaggcggacagtaccttctgcatcacgtcctcagggctgctgtgcgagttcagtgatcgaaggcttttggacaagtgggtggagctgagggtctaccccgaggtgaaggatagtaaccaggcctgcctgccccccagttcctttattacctgctcctcagacaacaccatccgcctgtggaacacagagagctccggggtgcatggctccaccctccaccgaaacatcctcagcagtgacctcattaaaatcatctatgtggatgggaacacccaggccctgctggacacagagctgcctggaggagacaaagctgatgcatccctgttggatccccgcgtgggcatccgctcggtgtgtgtcagccccaatggacagcatctagcatcaggggaccgtatgggcacacttagggtgcacgaacttcagtccctgagtgagatgctgaaggtggaggcccatgactctgagattctgtgcctggagtattctaagccagacacaggtctgaaactgctagcatcggcgagccgggaccggctgatccatgtgctggatgccgggcgggagtacagcctacagcagacgctggacgaacactcatcctccatcactgctgtcaagtttgcagccagtgatgggcaagtccgcatgatcagctgtggagcagacaagagcatctacttccgcactgcgcagaagtctggagatggagtgcagttcacacggacacaccacgtggtgcggaagacgaccctctatgacatggatgtggagcccagctggaagtacacggctatcggctgccaggaccgaaatattcggatatttaacatcagcagtggaaagcagaagaagctgtttaaagggtcacagggtgaggacggcacactcattaaggtgcagacagacccctcagggatctacattgccaccagctgttctgacaagaatctctccatttttgacttctcctcaggcgagtgcgtggccaccatgtttggccactcagagattgtcactggcatgaaatttagtaatgattgtaaacatctcatctctgtgtctggggacagctgcatatttgtgtggcgcctgagctctgagatgaccatcagcatgaggcagcgtctggccgagttgcgccagcgtcagcggggcggcaagcagcaaggaccatcctctccccaaagggcttctggacccaaccggcaccaggccccatcaatgctgtctcctggaccggctctctcatcagacagtgacaaggagggagaagatgaggggactgaagaagaacttccagcactgcccgtccttgccaagagtaccaagaaggcactggcctcggtccccagcccagctttgccccgaagcctgtcccactgggagatgagtcgggcacaggagtccgtggggttcctggacccagctcctgcagccaacccaggacccagaagaagagggcgctgggttcagccaggtgtggaactgagcgttagatccatgctggatctgcggcagctggaaacactggccccaagcctgcaggaccctagccaggactcgctggccatcatcccatctggtcccaggaagcatgggcaggaggcccttgagacttcactcactagccagaatgaaaagccccctcggcctcaggcttcccaaccttgttcctatccccatattatccgattattgtcacaagaggaaggggtctttgcccaagatctggaacctgcacccattgaagatggtattgtctacccggagccgagtgacaaccccaccatggataccagtgagttccaagtgcaggctccagcccggggaactctgggaagagtgtacccaggcagcaggagctcagaaaagcacagccctgacagtgcctgctctgtggattacagcagcagctgcctttccagcccggagcaccccactgaagactctgagagcacggagcccctcagtgtggatggcatctcctcagaccttgaagagccagctgagggtgatgaagaagaggaagaagaggagggaggcatgggcccctatgggctacaggagggcagcccccagactccagaccaggagcagtttctaaaacagcactttgagactctggccagtggagctgctccaggggccccagtgcaggtcccagagaggtcagagtctcggagtatctcttcacgattcctgttgcaagtacagacccgcccactcagggaaccatccccatcctcctcaagcctggcactgatgtcgagaccagcccaggtgccacaggcatctggtgagcagccgagaggcaatggtgccaatccccctggagcacccccggaggtggaaccgtcctctggcaaccccagcccccagcaggcagcctctgtgctgttgccacgatgccgtctcaaccctgacagcagctgggctcccaagagagtggccacagccagccccttttctggactccagaaggcccagtctgtgcacagtctggtgccacaggaaagacatgaggccagtctgcaggccccttcaccaggcgcactgctgtctcgggagatcgaagctcaggatggtctgggctccctgcccccagctgatggccgtccgtctcggcctcactcctatcagaaccccaccaccagttccatggccaagatatcccgcagtatctctgttggggagaacctgggcctggtggctgaacctcaagctcatgcccccatccgagtctcaccactcagcaagctggccctgcccagccgggctcacctggtcctggacatccccaaaccactgcctgaccgtcctaccctggctgcattctctcctgtcaccaaaggccgggcccctggcgaggcagaaaagcctggcttcccggtgggcctaggaaaagctcacagtacaactgagagatgggcctgtttgggggagggcaccactcccaagcctaggacagagtgccaggctcatcctgggcccagcagcccctgtgcccagcaactgccagtcagcagcctcttccaaggccctgaaaacttgcagcccccaccccctgagaagactcccaaccccatggaatgcaccaagccaggggcagccctgagccaggactcagagccagcggtgagcctggagcagtgtgagcagctggtggcagagctccgcggcagcgtgcgccaggcagtgcggctctaccactcggtggctggctgcaagatgccctcagcagagcaaagtcggattgcccagctcctcagagacaccttctcttcagtgcgacaggagctggaagctgtggctggggcagtgctgtccagcccaggcagcagccctggggctgtgggagccgagcagacacaggccctgctggagcaatactcagaactgttgcttcgagccgtggaacggcgtatggaacgcaaactctgagttctggaagcctgtcccaagtgaatgaatgctccagcgattccaaactgcagcccctctgcccctcaccaaaacctgcggggctgcttggagtggaaagcagggagcagtgttcagaggcaaagcagccttcccagccgctcctcgtggggggcctgtatttattaatttatttccctgactgttgcctcacttccttggaactcctgcctccacagcccctccagtggcagggacaggtcttgggtctttgtcatcttggtgctgtgagaggtaggagggcagcctgccccatctaggaatctgggaagggctggccctctcttagaagccatttgaaattactgcagggattagctccctgtggtggagcatacacagggtactctggggtcgaggtgagaggtgatgtggtattcagtgcccgtcagccaactgtgggccttcacctctacctgcacttcccctctcacaccagctgcactcccgtggctgccagagcagggtggttttccccaatacctggagctcagaaaggcagagccatctggccctccagggtgtccccagccatcaggagacttgagttggtatttggacctgagcccgcacattccactcccattctccctccaagaggggcccagcattgtatttccctgtgaccccttactctcctggccagaacttgagccagctgtgggatgttgctgcaggacagtaagccctcacctgggcaaacatgaagctctggcctcctttcctcagccccttgttcttccctgtcctccaccctggaccccagccggctgctggagcccagaggccaccttctccctgcatcctgaatgatgcttagtcagaagcctgtgttggaacatcccccgtccccttctgcatgtctgaggccaccggcaaccgccgccccactccagatttgcccccgccctgttttgaaagccccttatttataacttttatactttgtgcaggtcgcggcgcttcctgcctcatcctcggctgcatggggcgggggcgctgtttttaacgtgcccgtttgtactgatgtatgaacttgtcaataaacacaattgtttgttaaccctggga

SEQ ID NO: 334188 - DNA, 880 bp, Homo sapiens
cgcgtcggctccgcccacccagcccgcggcttggcccaggcggtagttcgcgttttgagccgatcgtgccaccatagctcctgctgctgcctctaccgctgcggctaccgcggcggagctgaaattgccgaacgcgatgcccgagggcgctgtgagcggggtggccttagctcgccgaggctggtcagtgagagggcatactgggaagccctctggagtgggaagacagtgccgctgttgagacaagacccaggactgggccggggactgtcccaaagggtttctcgtcataatggctgtggaagggtcaaccattaccagccggatcaagaatctgttgagatctccatccatcaaactgcgcaggagtaaggcaggaaaccgacgagaggacctcagctccaaggtgaccttggagaaggtgctgggaattacagtgtctggaggcagaggacttgcctgtgacccccgatcaggtttagttgcttacccagcagggtaagtaagcgccttggaagagatcttgatgcatgggaatttatagccacgctagagcagttgggatgggcagggattttctggtatcttctggaagatagatacaggttaatgttttgttgtcatttttgtaaagagacgcaggaccaggtaaaggttctttgtcgggtgctgtcattgttgccatcctgtgctgcttttcagttatctaccccacctcccacacacagatttacactttatgttacacacagttcccagcaccatcttcagtaactaccttccagtcatttaaaaaacagctttattgagatgtaattcacataccatataactcactatttaaaatacccaattcagtagttttttagtatattcacag

SEQ ID NO: 334189 - DNA, 358 bp, Homo sapiens
tagttagagcccccaaggcttcagcaaacattttgctcatcacttgtaggactagcagtaaatgtaatcattgcaagactgagctaacacatctgctaacagggttgttcatttgagtaaacagcaaggtgataaggcgcagggacggaccattggattgagtcagacaggcccgagtacaaaaaccagcctcactacttaaatcttacatagcccattaagagtaagttgcttcactttgggaggctgaggcggacagattacgaagtcaggagatcgagaccatcctggccaacatggttaaacctcatctctattaaaaaaaaaatacaaaaattaactgggcatggtggtgggc

SEQ ID NO: 334190 - DNA, 204 bp, Homo sapiens
gggaaaaaggaaaaccaacaatactccctggacctcccaaaccttcttgtcttcaagtcctaagcacaacaaagaatgcaaaaggagagacacactgcatatgcctatgtggattctcatatgcttatgttccagtgacaccttcccatttgtcttgtgctaagtaaacccacaggtttgtgtaataaagacaaaaagcatgcc

SEQ ID NO: 334191 - DNA, 397 bp, Homo sapiens
tctttgctcaattccagcaaatgtttacatttattcagcagatatttattcagcaacttctaagtactcaaaaattctatttatgctgttctatttctattcatggaggtgtactgcctacaaaatcattttgtgctagacactatggctaaaaccaaataaagacaaggttcttcccttcatggtgtttacatactggtgagaatagctaaatagtcctgtgaaactttcccttattatagtatcaaatactgattgtacctttctttgaacatttgtaatatttagcctctcccagtttcgtatctgcatgtatttggtcttataggcattttgttttatgacattttatctgttctttttatttgattaaagtcccttttgaagcaataactat

SEQ ID NO: 334192 - DNA, 537 bp, Homo sapiens
ctatctataatataatccattggaaatgctccaatatcaattctggatatgtaatttaaatgagggtcctggaaagctcaggcatcagttctaatattactctattctgaaagtttcttttatttcttgttcctcaaacatcatctttaatttataggctatcaattccttccttaagactattactgctaacttatggaagtggaagttgtttcagaaaagttttgcttctctgagtaactgagtaaattaattggttaaaatgaatagagagatctctgttcaggaaattcatctctcaccacatgataaatctgactttggtttaaagagaaagaaataaaatatgtcttttagccaagaattattttattattattcatttaggcaacaaatatttatgtgcctaccttgtacccaggaaggttctatggagaaattgcagaaacctgcatataaagccttttgggactttgtatggttgatgcaattgactccaaagtttgccgtacttacttaggccttccaaatgcctct

SEQ ID NO: 334193 - DNA, 978 bp, Homo sapiens
  misc_feature (862)..(862): n is a, c, g, or t
aactaaggctaggtacgaggctgggtgggtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccatcaaattgcggtgatgccagngcctttggggaacagttaaaatccgcagggggtggcatacgcgcatttggtccatctccttcccgagaactcggtgggccggtttccccggttcagtcgtaccaggtccttgccaa

SEQ ID NO: 334194 - DNA, 1751 bp, Homo sapiens
cggacgcgtgggtcgacccacgcgtccgcggacgtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgctgaaacaacacccaaacacacaacaacatacacaccacaaaacaaaacacacacaccccaaagcacaaaaaaaaaggggggcaacccacaagagaaccctcaaggagggaccacacaaaaaaagaaaaaaaggttatcacaaacggaggcccacaagagacgcaataatacagcgaacgacggacgactacacaacaagagcagagaaaaccgacaggacacgtcgaagaccaaaccagagcgagcacatgcgaaccacccgagacaaagaccgagacatcaacagctgaagctacacagccagacgcgcaagctccgcaagagtaataagccggaggagaagagacgcaagacgcaacaccgaagcgaacgcggacacaacagaaggagagaaaacaaggagacagacaagaagagaaaaggaacagaacaaaagggcacagcagcccggacgacggcactaacaggaagcaaaaaagagagcaagcgcagagaacgactcagacgcatagcaaccgagcagacaagcgccgcacaacaacgaccgcagcagccgacagacgaacacacagagcgcagcaaacgagagcgaaggacgcgagagcggcctgcgaagagagacaggacgagagcagaaacacggcacacgacaccagagagagaggcaagagcagcaggagagcagacaagccggacacgaagagaccaagacagccacaccagccggagagaagacagcaggcgacagagacaaacagcaacagagcgaagcacagacgaagagagcagagcagcagagcgagtagagcaaagggaaagcaaaggcagaggacacacaaagacgaaccagaagagacacgccagagaccgcgcacagcgagcacaacgacgagaagagaagaggaacgggaggcgagcagagagagtcatagagtctcatagcggtatagtagaggaaagaggacagatacagtctgggtatgcgaggtgatatcagatggtaatcgagagcaatgccatcacaaaggtggaagcgagagcgacagaggagtgaagaaggaaggagagagtagaatagcagagggaggagaggggcggctatgagcgagtggatgggggtgaagagctgcgacgaaacagggtgagagagagaggcgagataaggtcggaagagtcgagatgagcagagggacaagagacgaagcctcgagacagacggcagggcgatgaaagga

SEQ ID NO: 334195 - DNA, 608 bp, Homo sapiens
actggaagtactgagaaaccaggctctccacacatggctcctttgcctgtctccgaaccaaagctccctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgtaagcagatggtttctctaatataaattacactacactgtgttcacactaagcagatttt

SEQ ID NO: 334196 - DNA, 240 bp, Homo sapiens
tcccttcattattgcaaagtgctgggattacaggcatgggccaccgctcccgggctttttttcctagtcttgattctttctaggaaagacttatgtataattgctttttaaaatgcagtgctttactttaaactaaggggaactttgcggaggtgaaaacctttgctgggttttctgttcaataaagcaggatgcggccacgcccctttttttttccctgtgaaagaaataaaactgcgt

SEQ ID NO: 334197 - DNA, 2549 bp, Homo sapiens
aactaaggctaggtacgaggctgggtgggtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334198 - DNA, 2779 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgggccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334199 - DNA, 3849 bp, Homo sapiens
gcctcccacagtacttggattacaggcatgagccaccatgcccagccgataatttgccattctgtatttatttgcgtgttagagaccagttaaagttaagacactttctaaatagaagtcttgtatatggggcttttgagaaagtgttttcccgtgatgctggggggaaacacacatattcaaattacttgtataaaacagtttattctgtgtttaggaacttgtaggggtgaaatgctgacctgtgttactctttctttccatgatcagcgtccagaggaccagaggttaatttattctgggaagctgttgttggatcaccaatgtctcagggacttgcttccaaaggtacatcacttacacattaacttctgaatgtttttaagcactcaccaggttaggttcaggtccttaagtaccttcgtattacttttagcaggaaaaacggcatgttttgcatctggtgtgcaatgtgaagagtccttcaaaaatgccagaaatcaacgccaaggtgtctgcctcttcatgatggtaacaatttgtatcattcagactttcaggggagtaataaaagaagttggataaaacgtttattgagagactgtatggtgttattaccaagtaatattttgtttctttcctaggaattagaaactgtattatcaacacaaagtgatgagttaatagtagcagattgttccgttagtgctgtagtagaaaggtggagttacatattgcactatcttatgggatatgatttgatctatggttactgtgtatctagattactgaactaacactaattgggtttttattgaatttagcacatagcaagtttcttcaaaggagtcactaatttttataaagagtacaaaagtgaatatatttcctttggaaattttcattgtgattagttggataggaaaagatcagagtttttatcaagtgatctttaaagaattttttttttttaaagatggtctcgctgtgtggcccaggcttttctcaaactcctgagggcaagcgatcctcccacctcagcctcctgagtagctgggactacaggcatgtgccactagacctggctctaaagacatatatgacacacgaaaccatttatttttcatttcacaatgtttattcacatatatggtattagtattctaatgtagtgatgcactctaaatttgcattatatttcctagaacatctgaacagagcataggaaattccctattttgccattatcagttctaacaaaaatcttaaaagcactttatcatttcatttccctgcactgtaatttttttaaatgatcaaaaacagtatcataccaaggcttacttatattggaatactattttagaaagttgtgggctgggttgtatttataaatcttgttggtcagatgtctgcaatgagtaaatttagcaccattatcaggaagctttctcaccaatgacaacttcattggaagattttaatgaaagtgtagcatactctagggaaaaaatatgaatattttagcatctatgtattgaaaattatgttgaataaatgtcagactattttttacataacgttgcttctgtttaattttgtcacgttcagaggtggggggtaggagatgtaagcccttgacagcaaaataattccttttgcttgatttcagacagttgcatcagctcctttgttctgtgttcatgttacacttatttaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334200 - DNA, 3761 bp, Homo sapiens
gcctcccacagtacttggattacaggcatgagccaccatgcccagccgataatttgccattctgtatttatttgcgtgttagagaccagttaaagttaagacactttctaaatagaagtcttgtatatggggcttttgagaaagtgttttcccgtgatgctggggggaaacacacatattcaaattacttgtataaaacagtttattctgtgtttaggaacttgtaggggtgaaatgctgacctgtgttactctttctttccatgatcagcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtgtctgcctcttcatgatggtaacaatttgtatcattcagactttcaggggagtaataaaagaagttggataaaacgtttattgagagactgtatggtgttattaccaagtaatattttgtttctttcctaggaattagaaactgtattatcaacacaaagtgatgagttaatagtagcagattgttccgttagtgctgtagtagaaaggtggagttacatattgcactatcttatgggatatgatttgatctatggttactgtgtatctagattactgaactaacactaattgggtttttattgaatttagcacatagcaagtttcttcaaaggagtcactaatttttataaagagtacaaaagtgaatatatttcctttggaaattttcattgtgattagttggataggaaaagatcagagtttttatcaagtgatctttaaagaattttttttttttaaagatggtctcgctgtgtggcccaggcttttctcaaactcctgagggcaagcgatcctcccacctcagcctcctgagtagctgggactacaggcatgtgccactagacctggctctaaagacatatatgacacacgaaaccatttatttttcatttcacaatgtttattcacatatatggtattagtattctaatgtagtgatgcactctaaatttgcattatatttcctagaacatctgaacagagcataggaaattccctattttgccattatcagttctaacaaaaatcttaaaagcactttatcatttcatttccctgcactgtaatttttttaaatgatcaaaaacagtatcataccaaggcttacttatattggaatactattttagaaagttgtgggctgggttgtatttataaatcttgttggtcagatgtctgcaatgagtaaatttagcaccattatcaggaagctttctcaccaatgacaacttcattggaagattttaatgaaagtgtagcatactctagggaaaaaatatgaatattttagcatctatgtattgaaaattatgttgaataaatgtcagactattttttacataacgttgcttctgtttaattttgtcacgttcagaggtggggggtaggagatgtaagcccttgacagcaaaataattccttttgcttgatttcagacagttgcatcagctcctttgttctgtgttcatgttacacttatttaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334201 - DNA, 2763 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgggccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334202 - DNA, 2091 bp, Homo sapiens
tcgatttgaattcttgattttaatttaaacttagttttcatttgttcatactcaacccactcaaaatgagtgttttttcaaatctatgtataggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334203 - DNA, 2071 bp, Homo sapiens
actggaagtactgagaaaccaggctctccacacatggctcctttgcctgtctccgaaccaaagctccctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334204 - DNA, 1991 bp, Homo sapiens
ggctgtggtcgttctagagtatccccctggagcgttttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334205 - DNA, 2556 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgggccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334206 - DNA, 3430 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgggccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaaggcaggagaattgcttgaactggggaggcagaggttgcagtgagccaagatcgcaccactgcactccagcctgggtgacagagcaagaccctgtcttagaataaatacataataaatagtatgtattctggcactttcgatacaaggaattcatggcttggttgtatggtcccaagaacatatcaatcctgtgttaatataagaatattatcttgtcctctagataagctaccttaccttccaggctcacaaaccacaagtatgtagccatactgaggcatggaacagaaaactgtattgttttgaatgagaacacatttgcctttatcaggccacagctgccttccagggtaaagtcaggcactgactgttagcatggccctgaaaggcaagggaaccttcacatacctgacatttggttttagctgtggcccgaagcagtagttctcaactgggggtggttttgtaccctctctccccaggggacatttggcaatgtgtagctatttttggttgtcacatctaggggaagtggtcctgctggcgtctagttagtagaagcaagagtgctgctgaattttctacaatgcacaggacaactcccacagtaaatatttggctcaatatgtcactagtgccaaagctgagaaagcctggcctagagtgatgggtcttcgtggttgaaactaaaagaagaaattttcctgtatagtaaaaatggatttttattttagcttttaaaaataaaaaaggaataattagaatataatgaacactcaaatatccacaattagtcattgttaatattttattatatttaagacttgggatttaattggtttcttcaaataaaacgtttagttaatattttctgtagtctctagaatcatatatttaaaagaccaaatgtaggttgtcattatgttatatataattatagctttgtaggtatatgcattctccccgctctgttcaggttttcaagggtaaggtttagttcatataaataagcatttattgagtgcatactatgtgccaggtgctgtttatatggctgggtgtgcaatgatgaataaaacacagtccctgccttcaaggaccttacagactggtgagaatgtctgggagacagtgtgatcaaatgcctctgtagatgggtcttgcagtgagcttatcagggtgctgctgtgattagaggtggggagccttggattcttgagtaagtctcactgtgacatcagctaagatggacttttatgtgcttcctttgaaggcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334207 - DNA, 2825 bp, Homo sapiens
cgggcctgtaatttacttgggtggctaaggcaggagaattgcttgaactggggaggcagaggttgcagtgagccaagatcgcaccactgcactccagcctgggtgacagagcaagaccctgtcttagaataaatacataataaatagtatgtattctggcactttcgatacaaggaattcatggcttggttgtatggtcccaagaacatatcaatcctgtgttaatataagaatattatcttgtcctctagataagctaccttaccttccaggctcacaaaccacaagtatgtagccatactgaggcatggaacagaaaactgtattgttttgaatgagaacacatttgcctttatcaggccacagctgccttccagggtaaagtcaggcactgactgttagcatggccctgaaaggcaagggaaccttcacatacctgacatttggttttagctgtggcccgaagcagtagttctcaactgggggtggttttgtaccctctctccccaggggacatttggcaatgtgtagctatttttggttgtcacatctaggggaagtggtcctgctggcgtctagttagtagaagcaagagtgctgctgaattttctacaatgcacaggacaactcccacagtaaatatttggctcaatatgtcactagtgccaaagctgagaaagcctggcctagagtgatgggtcttcgtggttgaaactaaaagaagaaattttcctgtatagtaaaaatggatttttattttagcttttaaaaataaaaaaggaataattagaatataatgaacactcaaatatccacaattagtcattgttaatattttattatatttaagacttgggatttaattggtttcttcaaataaaacgtttagttaatattttctgtagtctctagaatcatatatttaaaagaccaaatgtaggttgtcattatgttatatataattatagctttgtaggtatatgcattctccccgctctgttcaggttttcaagggtaaggtttagttcatataaataagcatttattgagtgcatactatgtgccaggtgctgtttatatggctgggtgtgcaatgatgaataaaacacagtccctgccttcaaggaccttacagactggtgagaatgtctgggagacagtgtgatcaaatgcctctgtagatgggtcttgcagtgagcttatcagggtgctgctgtgattagaggtggggagccttggattcttgagtaagtctcactgtgacatcagctaagatggacttttatgtgcttcctttgaaggcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334208 - DNA, 1654 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgggccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaaga

SEQ ID NO: 334209 - DNA, 1247 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgggccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataatccgagatgcgggcagcgccccgcgctcttatgacaatacgcaacatcgatgatact

SEQ ID NO: 334210 - DNA, 1400 bp, Homo sapiens
aagcaggctgtacggtcggaagcgtaagatcaggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334211 - DNA, 1241 bp, Homo sapiens
  misc_feature (1138)..(1138): n is a, c, g, or t
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgggccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaccaaattnggggtgatgcccagggccatttggcaaaaggtgcaaaaccgcaagtcggtgagcttccggactactggggcacggtccacaacccggagagaccgatggcccg

SEQ ID NO: 334212 - DNA, 1332 bp, Homo sapiens
agaaatccccgtgtgggggaatgcagcagctctgccatcctcacgactgtcggtctgtgcaatcttcctggactgctgagaggaccgcccgctattaaagctatccggatcatagttttaaatggactaccgtgtttgaacacctgaagtgccaacgtacgtctgcggacgagtggatgaaagatggatctctgtaagcatggtgtcttcctgtcctgccaggcgggcttccgtggtcatctcgtgccctgcagacaggctcttggcacagcatatgatccatgagttgacgcatctcgagctgcggtaccctctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334213 - DNA, 981 bp, Homo sapiens
ctcggtacccgacggcttcaacggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334214 - DNA, 1614 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgggccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334215 - DNA, 2277 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgggccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtgtctgcctcttcatgatggtaacaatttgtatcattcagactttcaggggagtaataaaagaagttggataaaacgtttattgagagactgtatggtgttattaccaagtaatattttgtttctttcctaggaattagaaactgtattatcaacacaaagtgatgagttaatagtagcagattgttccgttagtgctgtagtagaaaggtggagttacatattgcactatcttatgggatatgatttgatctatggttactgtgtatctagattactgaactaacactaattgggtttttattgaatttagcacatagcaagtttcttcaaaggagtcactaatttttataaagagtacaaaagtgaatatatttcctttggaaattttcattgtgattagttggataggaaaagatcagagtttttatcaagtgatctttaaagaattttttttttttaaagatggtctcgctgtgtggcccaggcttttctcaaactcctgagggcaagcgatcctcccacctcagcctcctgagtagctgggactacaggcatgtgccactagacctggctctaaagacatatatgacacacgaaaccatttatttttcatttcacaatgtttattcacatatatggtattagtattctaatgtagtgatgcactctaaatttgcattatatttcctagaacatctgaacagagcataggaaattccctattttgccattatcagttctaacaaaaatcttaaaagcactttatcatttcatttccctgcactgtaatttttttaaatgatcaaaaacagtatcataccaaggcttacttatattggaatactattttagaaagttgtgggctgggttgtatttataaatcttgttggtcagatgtctgcaatgagtaaatttagcaccattatcaggaagctttctcaccaatgacaacttcattggaagattttaatgaaagtgtagcatactctagggaaaaaatatgaatattttagcatctatgtattgaaaattatgttgaataaatgtcagactattttttacataacgttgcttctgtttaattttgtcacgttcagaggtggggggtaggagatgtaagcccttgacagcaaaataattccttttgcttgatttcagacagttgcatcagctcctttgttctgtgttcatgttacacttatttaggtggctgaatccacagaggagcctgctggttctaatcggggacagtatcctgaggattcctcaagtgatggtttaaggcaaagggaagttcttcggaacctttcttcccctggatgggaaaacatctcaaggtgagtgttataataaagatcttggcttatgcaacatgaatgttcctcgtttgcatcaatttaagaataaggtatgtttacacgtatataatcagaacttttaaacatacagaattttgctttataaatagcttcgctttaaagatctcttatatatttaacttttcttaatacacagccttttagtacacacaaatttaaaaagtaggtaatgcatatattgaaaaa

SEQ ID NO: 334216 - DNA, 857 bp, Homo sapiens
cgtccctcacaaacctgaaacaccacaactccaggaaggaacaaggggcagaagcaggaagcagtttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334217 - DNA, 869 bp, Homo sapiens
tcccttcattattgcaaagtgctgggattacaggcatgggccaccgctcccgggctttttttcctagtcttgattctttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334218 - DNA, 817 bp, Homo sapiens
tcaagcttctaacgatgtacggggtttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334219 - DNA, 957 bp, Homo sapiens
  misc_feature (7)..(7): n is a, c, g, or t
  misc_feature (854)..(854): n is a, c, g, or t
aaacccncaataggctaaggtcgagggctgtgtgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaccaaattnggggtgatgcccagggccatttggcaaaaggtgcaaaaccgcaagtcggtgagcttccggactactggggcacggtccacaacccggagagaccgatggcccg

SEQ ID NO: 334220 - DNA, 628 bp, Homo sapiens
tcgatttgaattcttgattttaatttaaacttagttttcatttgttcatactcaacccactcaaaatgagtgttttttcaaatctatgtataggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgtaagcagatggtttctctaatataaattacactacactgtgttcacactaagcagatttt

SEQ ID NO: 334221 - DNA, 2838 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgggccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334222 - DNA, 4047 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgggccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtgtctgcctcttcatgatggtaacaatttgtatcattcagactttcaggggagtaataaaagaagttggataaaacgtttattgagagactgtatggtgttattaccaagtaatattttgtttctttcctaggaattagaaactgtattatcaacacaaagtgatgagttaatagtagcagattgttccgttagtgctgtagtagaaaggtggagttacatattgcactatcttatgggatatgatttgatctatggttactgtgtatctagattactgaactaacactaattgggtttttattgaatttagcacatagcaagtttcttcaaaggagtcactaatttttataaagagtacaaaagtgaatatatttcctttggaaattttcattgtgattagttggataggaaaagatcagagtttttatcaagtgatctttaaagaattttttttttttaaagatggtctcgctgtgtggcccaggcttttctcaaactcctgagggcaagcgatcctcccacctcagcctcctgagtagctgggactacaggcatgtgccactagacctggctctaaagacatatatgacacacgaaaccatttatttttcatttcacaatgtttattcacatatatggtattagtattctaatgtagtgatgcactctaaatttgcattatatttcctagaacatctgaacagagcataggaaattccctattttgccattatcagttctaacaaaaatcttaaaagcactttatcatttcatttccctgcactgtaatttttttaaatgatcaaaaacagtatcataccaaggcttacttatattggaatactattttagaaagttgtgggctgggttgtatttataaatcttgttggtcagatgtctgcaatgagtaaatttagcaccattatcaggaagctttctcaccaatgacaacttcattggaagattttaatgaaagtgtagcatactctagggaaaaaatatgaatattttagcatctatgtattgaaaattatgttgaataaatgtcagactattttttacataacgttgcttctgtttaattttgtcacgttcagaggtggggggtaggagatgtaagcccttgacagcaaaataattccttttgcttgatttcagacagttgcatcagctcctttgttctgtgttcatgttacacttatttaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334223 - DNA, 2926 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgggccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaaggtacatcacttacacattaacttctgaatgtttttaagcactcaccaggttaggttcaggtccttaagtaccttcgtattacttttagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334224 - DNA, 2715 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgggccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaagtttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334225 - DNA, 2025 bp, Homo sapiens
gccgactctcgaggatccacggacgaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334226 - DNA, 2626 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgggccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaagctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334227 - DNA, 2548 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgggccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334228 - DNA, 2364 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgggccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334229 - DNA, 1552 bp, Homo sapiens
gaatggtaaccacccaacgtgatgcaggtacataacaacggtggcccccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334230 - DNA, 2576 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgggccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaagtttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaaaaaaaaaatttttggggggtagggccctcgaaaaagagctttttaagaaccacttcgcgttgtgggagcgcgcgcggggcccccatatggtgttattggtgaacccgtgtggtcaaatagggtgtttcccaaagggaaaactcgggaacagagaacacagtgtgctgtgggattttcttcccaatttaaaaaaacgcccgcggggggaaacaccgaggggtgttccttgagaacacaaatacccaaagagtggggtcacaggagggccacaaaacaaggggggaccttattacacacggggggagtcccaacgggaaagcgcggaatgtcaaaatttatacccccgagcacttcggggggaaaagagaacgaagagagacagaggaaaaaagagagagggaaagagagacgagagaagaaagaaagaaggagggaaaggaaggagaggaggagaggggggaggagagaagagggagagcagggaagagcaagagaggcaaggaaagacaggagagcgagacggaaagagggaggcaggaggagagagagggcgaggggcggagagagggaggagaggaacaggggacacaagaagagagcagagggaagaagaggggagagcggggacgagagagaaagg

SEQ ID NO: 334231 - DNA, 1267 bp, Homo sapiens
  misc_feature (1151)..(1151): n is a, c, g, or t
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgggccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccatcaaattgcggtgatgccagngcctttggggaacagttaaaatccgcagggggtggcatacgcgcatttggtccatctccttcccgagaactcggtgggccggtttccccggttcagtcgtaccaggtccttgccaa

SEQ ID NO: 334232 - DNA, 1068 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgggccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggtgagtgttataataaagatcttggcttatgcaacatgaatgttcctcgtttgcatcaatttaagaataaggtatgtttacacgtatataatcagaacttttaaacatacagaattttgctttataaatagcttcgctttaaagatctcttatatatttaacttttcttaatacacagccttttagtacacacaaatttaaaaagtaggtaatgcatatattgaaaaa

SEQ ID NO: 334233 - DNA, 221 bp, Homo sapiens
tcctggccctcttcttgaatttatgtcagacacatgtgaggcttcattcatcatatatttctaagcaggcttttgtgtgtctgtttgaattcttttccaagaattaggggaagtgggagttgggtcgtgatgtgacagtcaaaggacttagccggaaagggtagagttaatgcatgacagacaaggggactctcatctgaaaatttgtgtgtctttgtttc

SEQ ID NO: 334234 - DNA, 736 bp, Homo sapiens
aatagcagcttcctcagatagctttagtcaattcacaacttctgaacatgataaaagcatcttttactggctgtgaagttcttcaatatccttgtaattaccatcttctttcaataaggcaactattatcaatttggcccgaatagtagccaaactgattcacacacacacacacacacacacacacacacacacacacttctctctctcaatccaaagtagaagtaaatgttccatctaaaccacaagcatctttctattctagtgcaatataagtgaaaagatggtgaagtgactttatcctggtctttatagtgacaggacttttccaatatgctttgtaccattagcttcctgtaggcttaggtcttgccctagcttcatcttgctgttgtcccttttcaaatctttctaatcacattcaatttcacttctagaggtttttcttgttgccaagtccgtcttccaattatccatttttgtaaaatgtcacgtgggtttatccctgggagttaaagaggtgacacaacccacacagctgttgcctgagagtaactgacagtagatgtgcagtgatcaagagcgaagtgacaaaactggtcatgaccatgatgctcctgttatgtccagatgtgtagactgaagagctggcagagaagtctgtattttatacaattgctcacagttaatacatcatggtgactgaaatctgaactgtgttgttggcagccaggtg

SEQ ID NO: 334235 - DNA, 178 bp, Homo sapiens
ccaccaaaacctcccacatcagtcaacattgtaactgatgtacacccttcttaaacaatacaagggtgacccaacttccatttagatcataaagctttagttaactagaggaaaaaaaaaaaagtgccatgaagaaataccactatccccgaaaaacttcagaaaggttttctttgag

SEQ ID NO: 334236 - DNA, 465 bp, Homo sapiens
gaatccataccaatcttatctgctgtcaggtcaactggacacacttggaaaatgcctacatcataaacctaaagactctgggacacaaaggactgttttgagcagtgacttctttagttatgtcttttttttttcttctagttttcagtgtttacagtaccgtgctctttttcttgtccaacttcatttgatttctgttgtcagtgtgtctcttggtttttcttttgtttgtgtattgtgtgtttggtcattttaggttatatttttttcttttgctggatctttttgtgtgcgtgtgttcctgagtttccaatcctccccgccatcaaccatggtaaatcaaaagatggtattcaacccttcaaaggcccaaagcctgcggcccgcatagcaaacagccttgagaacacagcgtattgagcagcctacagagactggcatacccctgaccctactaccttccat

SEQ ID NO: 334237 - DNA, 544 bp, Homo sapiens
gggaagtgttcttattcctggtctacatatctgtgaataaccacaaaggcatgggtgggggtgggattaaagaaaagactgagagggctttaagttacaataggatgggttcccttaagaaaatacctagcttgattttgaaatttttgttagaggtaattttgtttccctggggatgtttttctctcctttctttttttatggagtctggggtggggaaatatgaagaaagtcatttcttctctaaattcttcgaaagtcccttgatcctttttccacaatagtgacctcccttgctgcatgaggcatgtgtaccttcttccatggaaaatttcaaaatgatgctggctattgtttctaataccatgttagtctgtgagatattgctaacttttccagctgagataggaaggatgaactagagcgaataaagatgttcaagtagcagttgaaagccttgatatggcctttttactctctctgtgtttcccttgtttttctcctttcctcatttcattgtgttctgcatcaaaccccctacatc

SEQ ID NO: 334238 - DNA, 222 bp, Homo sapiens
tgtctcatcatggtgatgcatatatgtacagcaactaactacttcagtttgccttccagtgttgtcctgcccaaagtctatgtattgaactacatattttactatcaattacatttattcccctttatattataactagatcacttatcaattaaaaaatgtataaagcatattatctatgaattttatttcaggttagtaaagtgggaattacaaaatatt

SEQ ID NO: 334239 - DNA, 176 bp, Homo sapiens
ttaacgatgtactctttcctttatgagaatttaattctctgaatatgatatgtttttaaaataagacaaactcaaaccagttgccaatagatcctcagctcctcctgaggtccttgttttatgggtctgttctactgtgtaattgtttagtttaacttggtaaacatgtcagtttt

SEQ ID NO: 334240 - DNA, 573 bp, Homo sapiens
ctttccaacgaaaattagaattttgggaaagttgtatacatgattcattcccaatacttacttagttgaagataataatgagtgtaaattttcaatattgtataatgtgtcattatttggaagttgtacacaactcattttctaaataaccagtttatgattttacaaaatcacggatgcttaaaagattcatttaaagtataagaaagaatatggaattttaatgtaacagaaggcaaaaaaactattaatattgtttcagattccatgttacaactacccatcaatgaattacaaataaacaagtttcagtatgttatcaaaaacagaacagccgcaatatctgaagaaaaacaagcctctcgtctctgtgaggacaaattttctgtatagaccaaaacaaactcttgcaattgattgcagagacatgcttgtcttctcttgtcaggaattaaagataatttgcaaatatgtaaaacattgccactttttaaaatattttttaaaataatggtaatattttattaaaatatattaacatgtaatgaactttaagatttctgggctttttta

SEQ ID NO: 334241 - DNA, 459 bp, Homo sapiens
atgtttttgctgctggaagctattcaagaattagttccgaaaaataagtaagatagtaaaattgattattactaaagactgtggggcccctttggttaaaaattgattattttcccgggcttttggccttttcttaggaaattagagatctatatatgggtaaaagaagaaaaacatgttttaggagcatcatttgtatctaatatctgttctcttgatacctgttaaactttaatcatatagaaagatttgaatagaaaagcaaatatggagtcaagccatatacggtagaggtatagaaacttagaaatttataactaaacgttatttctaccacttcagcaaactgaagactattcactgattcatttaaaatatgtggtggccattattatgtggaaacataagatacaattatcaaaatacttcatttgcatctggtatgaaaatgttcgtttc

SEQ ID NO: 334242 - DNA, 186 bp, Homo sapiens
cctacctgatatcaggatgagataatctcactgaacgtatatacggctagcaatagatgtggctgtggttctttggctgccatggtttgactatgctgggtgcttgccagacataactgcttcagagaaagctagaagaatattcttggacccagaagctagaccagcaggaggttgtagatggta

SEQ ID NO: 334243 - DNA, 240 bp, Homo sapiens
ctcaaagaaattacatcccaaggaactcacgttgaaacccaaatcagaacgtaaggaacgaggttcagatgctgaccctgggggagatggactgaggagggaggtgtccttccagtttggggactcagagaagcctgaggggggctaagctatttttcaagcataaggatgattggttatggatgattgggcagcatcctttgaaaagtcagtgtgacatgagcaaagctaggagagggg

SEQ ID NO: 334244 - DNA, 262 bp, Homo sapiens
cctagttttagaagtttccatatcaccagtcatggggctctgtgtcacatcaaagcaggcccacacacaaaaacccagaaagtggtcaaattagagaaattgaggccctttgttatttttattccaattctaaatttggaattatggaagccccttcagtggttctagttgccctcaattctgtaggttgagataggcttacattttttctctgtctctttatgctatcagtctatgatttcctaaactagatcatgagttc

SEQ ID NO: 334245 - DNA, 216 bp, Homo sapiens
cctagttttagaagtttccataaaaaacccagaaagtggtcaaattagagaaattgaggccctttgttatttttattccaattctaaatttggaattatggaagccccttcagtggttctagttgccctcaattctgtaggttgagataggcttacattttttctctgtctctttatgctatcagtctatgatttcctaaactagatcatgagttc

SEQ ID NO: 334246 - DNA, 257 bp, Homo sapiens
tccaactaaaactctttttcttcacggtcttgggtacatctttattggcagtgtggaaacggactaatacaccccatctttaccgaaaatacaaaaaactagccaggcatggtggcatgcacctgtagtcccaactacttgggagactgagatgcaaggttcacatgagcctgggaagtggaagctgcagtgagccgggagtgtgccactacaccccagcctggatgacagagtgagaccccatctcaaaataaata

SEQ ID NO: 334247 - DNA, 249 bp, Homo sapiens
cgcatctggccgactccactttcttaacctctaattcactcataaaccttctccaatctagcttgagccatccaccattcctaatctcttcaaggtcaccaaggaattccaagtggccagatctaattgacacttctctatcctcatcttaatctctcagcaatgctggacacaagcgactctccccctcttaacatctcttagcttctagcactctgcccccgtggctttcctcctacctcaaagcct

SEQ ID NO: 334248 - DNA, 516 bp, Homo sapiens
aagggataagggagaagagagaaataagaggaaaaaggaaacaaggcctgtgaataaatgaacatacattaaaaatatttaatttcagagcctggagtcctttgaaatagaaggttgcagatgaggatcatagaaggcttgtgtcaaaaacattgcctacctaataatgtatcccagggtcagccctgaaactgtcctaaaacaatcactggaataatccaagcaacactgcattttcagagaagcactcccctaaatgtgatacagtgtagaggcttaggagcctaatcaaaagaacaaagatctataggttctgagggctgaatggaacaggtgcttggcaattctaatatgtacttgcaagagagaaaaggtaactggacaaatgaatcactactgattttattcagagcacactgcagtgtctcttaacaagatcatgtttacctgcagttaaattaatcaccatagctcagccttctgaacttcaagtaatagcaaagggctcacaaggct

SEQ ID NO: 334249 - DNA, 612 bp, Homo sapiens
ttgtgtgttgaatctttggctaaacaattatttgttctaaattagtggaaaacctgttagcctcttttgagaatgctttgctctgaaaaggatttgcattttattttaccacaggcctgaggctgcattaagtctccttacaggagccctcgctcccaagaatgttgtgtttagtcctcccgcttgccgtcccctccagcaggcctcctctcccagccccaccagcgtgtcctcatagtccaccaccttcatttttttcatgtcggtattcacagttcagctcagggctttggggttgctttactttgtcccttggagattttttgtatgttctgtgggcccagcaatgcagcacacacacacacacacacacacacacacacacacacacacacacacactcacacacatacaccatttagatctttagtaggaggtcccttcagagtgtccagccaaccgttatcctggaaatagaggtttcaaagcatttttaaaatgaaaaagacaaagaaatggagggaggaaggaaagaggaaaagtaataccattataatactgagcatttggatgatgggaataaagaaggaaaaaacttttagatgatggtcc

SEQ ID NO: 334250 - DNA, 276 bp, Homo sapiens
tgacctcaggtgatctgcccgcctcggcctcccgaagtgctgggattacaggcgtgagccactgcgcccagtcgctatgtttattcttaattttaagattcatgactcactaaaatcttcccttaaaaaaatacaaataaaaaaatactttttcaagatgtagaactaagaaacaagttgaaaagatctgtctattcttgttcttccagttcttgctggaatttaccttttgccattaacccatagttttagcttgcttctgaacctagagaagga

SEQ ID NO: 334251 - DNA, 505 bp, Homo sapiens
gctctctcatcttggagcatgagccttccatcatctctaccagatgaactctcatttcttctttcaaaaaataaaaaacccaaaaaacccagagatcccaactgtcctggtgtctgcatagtctgcagcacacgccccctccatggcccttcctccataagcagaatcactcctcactgttcctgcagcacctcctgtgtgcccacacagctgtcctgcggtgggctgtgtgtgtgagtgtgccccctctaggacctgagctccttctggagggtgggcacagcatccattcattctgggaatcctggtcggcaccatgctagaacttctgcaagtgagtgcctttggtgctggcccatgggagagctgttggtaaggcatacttttgcagattccagttgctgctgaggttgttgctctttgcacaagtttcttctagtcaccagtgaagtgacatgtgtggcaggcatggcccagggaggctttttcataaagaagaggttga

SEQ ID NO: 334252 - DNA, 493 bp, Homo sapiens
tttactacatctatttttagcacctcatctccatggttcttgccctctcaaaaccaattatagtaaaatccatttaaacagagatactccagtccaagttaagttcttacattttcttttcctggaaagataggctacttatcccaagaattatttgaagttggttcattcttttttaagtgctgtattgaggaggagagaaaaatagtagataaaacattccaatagtacttcattttttttaaaccaatgaattaaaatccacacatattcaatagagaggtctataaaagtttgttaacttctcatgaaacagacatttccaacaatagtatgtaaacatggacatttacatattcaaaagctactttccaagatttttccctcctacccaggttgtcagtataatgacatcgatttaggctatcataggccttttgagctggaaggtcacccaagaaccgtatttgtttaacaccctcacttaaaaaga

SEQ ID NO: 334253 - DNA, 548 bp, Homo sapiens
gtattttggtaaagacattcatctcagtcgtttctctctcccagcttgaccttaggttaatatttcatttgggtcaagaaaagaatatgtaggagagctatgttgctttaacaagaaaatggacaaaaatggatagtttgcctcattaaagaacacgcatgctcgcagaagccattacaatcccgtcgtgcagcagcctgtgctattgaccagcctagaagtcatttttcgactcaaggggagaagggtgggtttctgctctttccttgcaccatctgaaggacacggcagaagataaaggaaaatggccatgagatgctccagcggagctgggtccaaggcctggcgctcaccaaagattgcactactctcagcatggtacaggaagacaactgatgggacaatgcaagctgggacaatctccaacccaaagggtatctcagaaaacagcactagagtctgaaatgattccacctggtcttagcagaaagctggcccggaagttgtaatacatgaagatccaacagccaccacgtgaccaagagaaa

SEQ ID NO: 334254 - DNA, 610 bp, Homo sapiens
gtattttggtaaagacattcatctcagtcgtttctctctcccagcttgaccttaggttaatatttcatttgggtcaagaaaagaatatgtaggagagctatgttgctttaacaagaaaatggacaaaaatggatagtttgcctcattaaagaacacgcatgctcgcagaagccattacaatcccgtcgtgcagcagcctgtgctattgaccagcctagaagtcatttttcgactcaaggggagaagggtgggtttctgctctttccttgcaccatctgaaggacacggcagaagataaaggaaaatggccatgagatgctccagcggagctgggtccaaggcctggcgctcaccaaagattgcactactctcagcatggtacaggaagacaactgatgggacaatgcaagctgggacaatctccaacccaaagggtatctcagaaaacagcactaggtgagaccacagcacaaccccagtcaacctttaaatcagaaaaggagctggaggatgcaattcattgatgtatagaaagttttaaaaagtaaaaactgaaatacagaaaacaaagtttgcaatgtgtaagaaataaaggactgaaatttgtacc

SEQ ID NO: 334255 - DNA, 252 bp, Homo sapiens
ttgcccggtacatcctttataataaaccagtaaatgtgtttccctgggttctctaagctgcattagcaattaaatgaacccaaagagagggttgtgggaacaccaagttgaaacaagtcagaagttctggaggctcagatttgtgactggtgggaagggagagggctgcttggtgggagtgagccctcagttgtggggcctgatgctgtatcagtgaggtagatactgtcatccaggctgggcgtgcagtgc

SEQ ID NO: 334256 - DNA, 2514 bp, Homo sapiens
ccggaactaacctcggctcccttgggaaggccgcgttgcatggccaggagcagcagtctgggccgcgagtgcgggacaccgaggtcaggtctcggaaagggaggacctcctcgtccccaggggccccaggccaggtgcacccttggccgcaggtgcacggtctccggaaagtgcaggcgcccacgtcccagctggaccatggcgcctccgcggaacgtggtgaagattgccatcaagatgcgtgacgccatcccgcagctcatccagctggaccaggcgaagcccctggccgctgtgctgaaggaggtgtgcgacgcgtggagcctgacgcactctgagcgttacgccctgcagtttgcggatgggcaccggagatacatcaccgagaataaccgcgcggagatcaagaatggcagcatcctgtgcctcagcacggccccagaccttgaggctgagcagctcttgggtgggctgcagagtaacagtcctgaagggcgccgggaagccctgaggcgccttgttccgctggcctcggacatgatctttgccagggaggtcatcagccgtaatgggctccagatactaggcaccatcattgaagatggggacgacctaggagaggtgctggccctcagcctgagggccttctcagagctcatggagcacggcgtggtgtcctgggagactctgagcatcccctttgtgaggaaggtggtgtgctacgtgaacatgaacctcatggatgcctccgtgcctcccctggcccttgggctgctggagagtgtgaccttgagcagcccagccctgggccagctggtcaagagcgaggtgcccctggataggctgctggtgcacctacaggtgatgaaccagcagctgcaaaccaaggccatggccctgctgacagccttgctgcagggggccagccctgtggaacgcaagcacatgcttgactatctttggcagaggaaccttcgccagttcatctataagaacatcatccacagtgcagcaccaatgggcgacgagatggctcatcacctgtacgtactgcaggctctcatgctggggctgctggagccgcgcatgcggacgcccctggacccctacagccaggagcagcgggagcagctgcaggtcctacgccaggctgccttcgaggtggagggggagtcctcgggtgccgggctaagtgctgaccgtcgccgttccctctgtgcccgagagttccgcaaactgggcttttctaacagcaacccagcacaggacctggagcgcgtgccccccggtctgctggccctggacaacatgttgtacttctccagaaacgcgcccagcgcgtacagccggtttgtgttggagaacagcagccgcgaggacaagcacgagtgcccctttgcccggggcagcatccagctgacggtgctgctgtgtgagctgctccgtgttggggagccctgctctgagacagcccaggacttctcacccatgttcttcggccaagaccagagcttccacgagctcttctgtgtgggcatccagctgttgaataagacctggaaggagatgcgggctacacaggaggacttcgacaaggtcatgcaggtggtgcgggagcagctggcccgcactctggccctgaagcccacttccctggagctcttccgaaccaaggtgaatgcgctcacttatggggaggtgctgcggctgcggcagactgaacggctgcaccaggagggcacactggctccccctatactggagctgcgggagaagctgaagccagagctcatgggcctgatccgccagcagcgcttgctccgcctctgtgaggggacgctcttccgcaagatcagcagccggcggcgccaggataagctgtggttctgctgcctgtcccccaaccacaagctgctgcagtacggagacatggaggagggcgccagcccgcctaccctggagagtctgcccgagcaactccctgtggccgacatgagggcactcctgacaggcaaggactgcccccatgtccgggagaagggctccgggaagcagaacaaggacctctatgagttggccttctcaatcagctatgaccgtggggaggaggaagcgtacctcaacttcattgccccctccaagcgggagttctacctgtggacagatgggctcagtgccttgctgggcagtcccatgggcagcgagcagacacggctggacctggagcagctgctgaccatggagaccaagctgcgtctgctggagctggagaacgtgcccatccccgagcggccaccccctgtgcccccaccccccaccaacttcaacttctgctatgactgcagcatcgctgaaccttgacagtgtggctggccatgggccacagctgcggccactgcagcagccatgaagggcagtgggtagaggagtgcaggcaccctgaccagcagagattgctgcagaaataaagtctgcttggctcttgggatatgttgagccagctctgtaccttgc

SEQ ID NO: 334257 - DNA, 1851 bp, Homo sapiens
cgggctgcaggaattcggcacgaggaagagagagagagagagagagagagagagagagagagagagagagagagagagagagctcgtgccgaattcggcacgaggagtttttttttttttttttttttttttaagtagagacggggtttcactgtgttagccaggttggcctccatctcctgacctcgtgatccgcccgccttggcctcccaaagtgctgggattacaggcgtgagccaccgcgcccagcctaagccccctttctttctaccccctcagcacatgcttgactatctttggcagaggaaccttcgccagttcatctataagaacatcatccacagtgcagcaccaatgggcgacgagatggctcatcacctgtacgtactgcaggctctcatgctggggctgctggagccgcgcatgcggacgcccctggacccctacagccaggagcagcgggagcagctgcaggtcctacgccaggctgccttcgaggtggagggggagtcctcgggtgccgggctaagtgctgaccgtcgccgttccctctgtgcccgagagttccgcaaactgggcttttctaacagcaacccagcacaggacctggagcgcgtgccccccggtctgctggccctggacaacatgttgtacttctccagaaacgcgcccagcgcgtacagccggtttgtgttggagaacagcagccgcgaggacaagcacgagtgcccctttgcccggggcagcatccagctgacggtgctgctgtgtgagctgctccgtgttggggagccctgctctgagacagcccaggacttctcacccatgttcttcggccaagaccagagcttccacgagctcttctgtgtgggcatccagctgttgaataagacctggaaggagatgcgggctacacaggaggacttcgacaaggtcatgcaggtggtgcgggagcagctggcccgcactctggccctgaagcccacttccctggagctcttccgaaccaaggtgaatgcgctcacttatggggaggtgctgcggctgcggcagactgaacggctgcaccaggagggcacactggctccccctatactggagctgcgggagaagctgaagccagagctcatgggcctgatccgccagcagcgcttgctccgcctctgtgaggggacgctcttccgcaagatcagcagccggcggcgccaggataagctgtggttctgctgcctgtcccccaaccacaagctgctgcagtacggagacatggaggagggcgccagcccgcctaccctggagagtctgcccgagcaactccctgtggccgacatgagggcactcctgacaggcaaggactgcccccatgtccgggagaagggctccgggaagcagaacaaggacctctatgagttggccttctcaatcagctatgaccgtggggaggaggaagcgtacctcaacttcattgccccctccaagcgggagttctacctgtggacagatgggctcagtgccttgctgggcagtcccatgggcagcgagcagacacggctggacctggagcagctgctgaccatggagaccaagctgcgtctgctggagctggagaacgtgcccatccccgagcggccaccccctgtgcccccaccccccaccaacttcaacttctgctatgactgcagcatcgctgaaccttgacagtgtggctggccatgggccacagctgcggccactgcagcagccatgaagggcagtgggtagaggagtgcaggcaccctgaccagcagagattgctgcagaaataaagtctgcttggctcttgggatatgttgagccagctctgtaccttgc

SEQ ID NO: 334258 - DNA, 2628 bp, Homo sapiens
ccggaactaacctcggctcccttgggaaggccgcgttgcatggccaggagcagcagtctgggccgcgagtgcgggacaccgaggtcaggtctcggaaagggaggacctcctcgtccccaggggccccaggccaggtgcacccttggccgcaggtgcacggtctccggaaagtgcaggcgcccacgtcccagctggaccatggcgcctccgcggaacgtggtgaagattgccatcaagatgcgtgacgccatcccgcagctcatccagctggaccaggcgaagcccctggccgctgtgctgaaggaggtgtgcgacgcgtggagcctgacgcactctgagcgttacgccctgcagtttgcggatgggcaccggagatacatcaccgagaataaccgcgcggagatcaagaatggcagcatcctgtgcctcagcacggccccagaccttgaggctgagcagctcttgggtgggctgcagagtaacagtcctgaagggcgccgggaagccctgaggcgccttgttccgctggcctcggacatgatctttgccagggaggtcatcagccgtaatgggctccagatactaggcaccatcattgaagatggggacgacctaggagaggtgctggccctcagcctgagggccttctcagagctcatggagcacggcgtggtgtcctgggagactctgagcatcccctttgtgaggaaggtggtgtgctacgtgaacatgaacctcatggatgcctccgtgcctcccctggcccttgggctgctggagagtgtgaccttgagcagcccagccctgggccagctggtcaagagcgaggtgcccctggataggctgctggtgcacctacaggtgatgaaccagcagctgcaaaccaaggccatggccctgctgacagccttgctgcagggggccagccctgtggaacgcaagcacatgcttgactatctttggcagaggaaccttcgccagttcatctataagaacatcatccacagtgcagcaccaatgggcgacgagatggctcatcacctgtacgtactgcaggctctcatgctggggctgctggagccgcgcatgcggacgcccctggacccctacagccaggagcagcgggagcagctgcaggtcctacgccaggctgccttcgaggtggagggggagtcctcgggtgccgggctaagtgctgaccgtcgccgttccctctgtgcccgagagttccgcaaactgggcttttctaacagcaacccagcacaggacctggagcgcgtgccccccggtctgctggccctggacaacatgttgtacttctccagaaacgcgcccagcgcgtacagccggtttgtgttggagaacagcagccgcgaggacaagcacgagtgcccctttgcccggggcagcatccagctgacggtgctgctgtgtgagctgctccgtgttggggagccctgctctgagacagcccaggacttctcacccatgttcttcggccaagaccagagcttccacgagctcttctgtgtgggcatccagctgttgaataagacctggaaggagatgcgggctacacaggaggacttcgacaaggtcatgcaggtggtgcgggagcagctggcccgcactctggccctgaagcccacttccctggagctcttccgaaccaaggtgaatgcgctcacttatggggaggtgctgcggctgcggcagactgaacggctgcaccaggagggcacactggctccccctatactggagctgcgggagaagctgaagccagagctcatgggcctgatccgccagcagcgcttgctccgcctctgtgaggggacgctcttccgcaagatcagcagccggcggcgccagggtctctgaatgggcatgggcagggggcagagggcaggcagagggcaggcagagggcggctggcttggtgtcaggacctctcagcactctggccctcttccctttctccacgcagataagctgtggttctgctgcctgtcccccaaccacaagctgctgcagtacggagacatggaggagggcgccagcccgcctaccctggagagtctgcccgagcaactccctgtggccgacatgagggcactcctgacaggcaaggactgcccccatgtccgggagaagggctccgggaagcagaacaaggacctctatgagttggccttctcaatcagctatgaccgtggggaggaggaagcgtacctcaacttcattgccccctccaagcgggagttctacctgtggacagatgggctcagtgccttgctgggcagtcccatgggcagcgagcagacacggctggacctggagcagctgctgaccatggagaccaagctgcgtctgctggagctggagaacgtgcccatccccgagcggccaccccctgtgcccccaccccccaccaacttcaacttctgctatgactgcagcatcgctgaaccttgacagtgtggctggccatgggccacagctgcggccactgcagcagccatgaagggcagtgggtagaggagtgcaggcaccctgaccagcagagattgctgcagaaataaagtctgcttggctcttgggatatgttgagccagctctgtaccttgc

SEQ ID NO: 334259 - DNA, 829 bp, Homo sapiens
ccggaactaacctcggctcccttgggaaggccgcgttgcatggccaggagcagcagtctgggccgcgagtgcgggacaccgaggtcaggtctcggaaagggaggacctcctcgtccccaggggccccaggccaggtgcacccttggccgcaggtgcacggtctccggaaagtgcaggcgcccacgtcccagctggaccatggcgcctccgcggaacgtggtgaagattgccatcaagatgcgtgacgccatcccgcagctcatccagctggaccaggcgaagcccctggccgctgtgctgaaggaggtgtgcgacgcgtggagcctgacgcactctgagcgttacgccctgcagtttgcggatgggcaccggagatacatcaccgagaataaccgcgcggagatcaagaatggcagcatcctgtgcctcagcacggccccagaccttgaggctgagcagctcttgggtgggctgcagagtaacagtcctgaagggcgccgggaagccctgaggcgccttgttccgctggcctcggacatgatctttgccagggaggtcatcagccgtaatgggctccagatactaggcaccatcattgaagatggggacgacctaggagaggtgctggccctcagcctgagggccttctcagagctcatggagcacggcgtggtgtcctgggagactctgagcatcccctttgtgaggaaggtgggtgggctttcctagggcagcgggtgggggcagtggagcagtggggctggcagatggtggggatccgtctagtagtctgaccctgcatggcactgcaatgcttgtgcacttggcc

SEQ ID NO: 334260 - DNA, 251 bp, Homo sapiens
gagggcgggagggcaggaggggcggcgccccctgccggcctcgctgagcctcgtgcccctcaggtggagcctgacgcactctgagcgttacgccctgcagtttgcggatgggcaccggagatacatcaccgagaatgtgagtcccctctccccagccccaagctcggccttccgacccctctaacccacctggccccgataactctggctcttcatcccactaccggagcgcgatctgttattcaccccca

SEQ ID NO: 334261 - DNA, 2282 bp, Homo sapiens
atccctccctgcccaggccgcgagaatgaccactccacttgcaggcgaagcccctggccgctgtgctgaaggaggtgtgcgacgcgtggagcctgacgcactctgagcgttacgccctgcagtttgcggatgggcaccggagatacatcaccgagaataaccgcgcggagatcaagaatggcagcatcctgtgcctcagcacggccccagaccttgaggctgagcagctcttgggtgggctgcagagtaacagtcctgaagggcgccgggaagccctgaggcgccttgttccgctggcctcggacatgatctttgccagggaggtcatcagccgtaatgggctccagatactaggcaccatcattgaagatggggacgacctaggagaggtgctggccctcagcctgagggccttctcagagctcatggagcacggcgtggtgtcctgggagactctgagcatcccctttgtgaggaaggtggtgtgctacgtgaacatgaacctcatggatgcctccgtgcctcccctggcccttgggctgctggagagtgtgaccttgagcagcccagccctgggccagctggtcaagagcgaggtgcccctggataggctgctggtgcacctacaggtgatgaaccagcagctgcaaaccaaggccatggccctgctgacagccttgctgcagggggccagccctgtggaacgcaagcacatgcttgactatctttggcagaggaaccttcgccagttcatctataagaacatcatccacagtgcagcaccaatgggcgacgagatggctcatcacctgtacgtactgcaggctctcatgctggggctgctggagccgcgcatgcggacgcccctggacccctacagccaggagcagcgggagcagctgcaggtcctacgccaggctgccttcgaggtggagggggagtcctcgggtgccgggctaagtgctgaccgtcgccgttccctctgtgcccgagagttccgcaaactgggcttttctaacagcaacccagcacaggacctggagcgcgtgccccccggtctgctggccctggacaacatgttgtacttctccagaaacgcgcccagcgcgtacagccggtttgtgttggagaacagcagccgcgaggacaagcacgagtgcccctttgcccggggcagcatccagctgacggtgctgctgtgtgagctgctccgtgttggggagccctgctctgagacagcccaggacttctcacccatgttcttcggccaagaccagagcttccacgagctcttctgtgtgggcatccagctgttgaataagacctggaaggagatgcgggctacacaggaggacttcgacaaggtcatgcaggtggtgcgggagcagctggcccgcactctggccctgaagcccacttccctggagctcttccgaaccaaggtgaatgcgctcacttatggggaggtgctgcggctgcggcagactgaacggctgcaccaggagggcacactggctccccctatactggagctgcgggagaagctgaagccagagctcatgggcctgatccgccagcagcgcttgctccgcctctgtgaggggacgctcttccgcaagatcagcagccggcggcgccaggataagctgtggttctgctgcctgtcccccaaccacaagctgctgcagtacggagacatggaggagggcgccagcccgcctaccctggagagtctgcccgagcaactccctgtggccgacatgagggcactcctgacaggcaaggactgcccccatgtccgggagaagggctccgggaagcagaacaaggacctctatgagttggccttctcaatcagctatgaccgtggggaggaggaagcgtacctcaacttcattgccccctccaagcgggagttctacctgtggacagatgggctcagtgccttgctgggcagtcccatgggcagcgagcagacacggctggacctggagcagctgctgaccatggagaccaagctgcgtctgctggagctggagaacgtgcccatccccgagcggccaccccctgtgcccccaccccccaccaacttcaacttctgctatgactgcagcatcgctgaaccttgacagtgtggctggccatgggccacagctgcggccactgcagcagccatgaagggcagtgggtagaggagtgcaggcaccctgaccagcagagattgctgcagaaataaagtctgcttggctcttgggatatgttgagccagctctgtaccttgc

SEQ ID NO: 334262 - DNA, 1817 bp, Homo sapiens
ggagccgcgcatgcggacgcccctggacccctacagccaggagcagcgggagcagctgcaggtcctacgccaggctgctggagagtgtgaccttgagcagcccagccctgggccagctggtcaagagcgaggtgcccctggataggctgctggtgcacctacaggtgatgaaccagcagctgcaaaccaaggccatggccctgctgacagccttgctgcagggggccagccctgtggaacgcaagcacatgcttgactatctttggcagaggaaccttcgccagttcatctataagaacatcatccacagtgcagcaccaatgggcgacgagatggctcatcacctgtacgtactgcaggctctcatgctggggctgctggagccgcgcatgcggacgcccctggacccctacagccaggagcagcgggagcagctgcaggtcctacgccaggctgccttcgaggtggagggggagtcctcgggtgccgggctaagtgctgaccgtcgccgttccctctgtgcccgagagttccgcaaactgggcttttctaacagcaacccagcacaggacctggagcgcgtgccccccggtctgctggccctggacaacatgttgtacttctccagaaacgcgcccagcgcgtacagccggtttgtgttggagaacagcagccgcgaggacaagcacgagtgcccctttgcccggggcagcatccagctgacggtgctgctgtgtgagctgctccgtgttggggagccctgctctgagacagcccaggacttctcacccatgttcttcggccaagaccagagcttccacgagctcttctgtgtgggcatccagctgttgaataagacctggaaggagatgcgggctacacaggaggacttcgacaaggtcatgcaggtggtgcgggagcagctggcccgcactctggccctgaagcccacttccctggagctcttccgaaccaaggtgaatgcgctcacttatggggaggtgctgcggctgcggcagactgaacggctgcaccaggagggcacactggctccccctatactggagctgcgggagaagctgaagccagagctcatgggcctgatccgccagcagcgcttgctccgcctctgtgaggggacgctcttccgcaagatcagcagccggcggcgccaggataagctgtggttctgctgcctgtcccccaaccacaagctgctgcagtacggagacatggaggagggcgccagcccgcctaccctggagagtctgcccgagcaactccctgtggccgacatgagggcactcctgacaggcaaggactgcccccatgtccgggagaagggctccgggaagcagaacaaggacctctatgagttggccttctcaatcagctatgaccgtggggaggaggaagcgtacctcaacttcattgccccctccaagcgggagttctacctgtggacagatgggctcagtgccttgctgggcagtcccatgggcagcgagcagacacggctggacctggagcagctgctgaccatggagaccaagctgcgtctgctggagctggagaacgtgcccatccccgagcggccaccccctgtgcccccaccccccaccaacttcaacttctgctatgactgcagcatcgctgaaccttgacagtgtggctggccatgggccacagctgcggccactgcagcagccatgaagggcagtgggtagaggagtgcaggcaccctgaccagcagagattgctgcagaaataaagtctgcttggctcttgggatatgttgagccagctctgtaccttgc

SEQ ID NO: 334263 - DNA, 1110 bp, Homo sapiens
gctgggaggcctgggccagggcagggggctgatctgggtacagagcttaggccctgagctgagcttgggcggccccaggtcatgcaggtggtgcgggagcagctggcccgcactctggccctgaagcccacttccctggagctcttccgaaccaaggtgaatgcgctcacttatggggaggtgctgcggctgcggcagactgaacggctgcaccaggagggcacactggctccccctatactggagctgcgggagaagctgaagccagagctcatgggcctgatccgccagcagcgcttgctccgcctctgtgaggggacgctcttccgcaagatcagcagccggcggcgccagggtctctgaatgggcatgggcagggggcagagggcaggcagagggcaggcagagggcggctggcttggtgtcaggacctctcagcactctggccctcttccctttctccacgcagataagctgtggttctgctgcctgtcccccaaccacaagctgctgcagtacggagacatggaggagggcgccagcccgcctaccctggagagtctgcccgagcaactccctgtggccgacatgagggcactcctgacaggcaaggactgcccccatgtccgggagaagggctccgggaagcagaacaaggacctctatgagttggccttctcaatcagctatgaccgtggggaggaggaagcgtacctcaacttcattgccccctccaagcgggagttctacctgtggacagatgggctcagtgccttgctgggcagtcccatgggcagcgagcagacacggctggacctggagcagctgctgaccatggagaccaagctgcgtctgctggagctggagaacgtgcccatccccgagcggccaccccctgtgcccccaccccccaccaacttcaacttctgctatgactgcagcatcgctgaaccttgacagtgtggctggccatgggccacagctgcggccactgcagcagccatgaagggcagtgggtagaggagtgcaggcaccctgaccagcagagattgctgcagaaataaagtctgcttggctcttgggatatgttgagccagctctgtaccttgc

SEQ ID NO: 334264 - DNA, 427 bp, Homo sapiens
cacagctactgtgtgccaagcactggagtaagtacattacaaatttcacccctactccccatctctataaaatgttatcctcatgcgacggaacaggaaaactgagaccaagggaattagccgcctcactgacagtcacatgctgagtggcagacaggactcaaatccagatgtgcccaactgcagagaccatgttctgtggagcaggcagccgcctctcagctctcactcagtgtttatgtagctggcgctaagtgccaggcggccagtgcaaggtgtggggtactcagagggaaccaaacagacaaggtccctgctctcacagagctcatatgctctgtccccagccctgtctctcttcttccaagcctggaagagggcaggaaccctccagtcacagggggttccactggcacaaacaaggaat

SEQ ID NO: 334265 - DNA, 581 bp, Homo sapiens
tttgagaccagcctgggcaacatagcaagacttagtctctacaaaaaattaaaaaataagttgggcatgtggtgcaggcctgtagtcccagctactagggaggctgaggcaggaggatcgcctgagccaacaagtttgaggctgcagtgagctatgatggtaccactgtactccagcctgtgtaacagagagagactgtgtctctaaaaaacaaaaacaagaaaactcgcatttgaaaaacaagacacaactgaaagactccaaacctaacccttttcagaaaatcagaggataaccatttacagtaaagaaaaagggtaattttaatggcagaagttaaaagttcaaagaaaattgcatgttgggtattttttgtatacttatcaccatgctgacagcagtaaggtgattcaagggaaatacatgaaattgttcctgcccataggaatgtgtgttaccttcagggagataagatgataacagtaaaagttatgtagtctactgtgtgtagaacactgccagtttctttatacacagacgtggtggttctccaaggtatatatattttatccctgttttag

SEQ ID NO: 334266 - DNA, 508 bp, Homo sapiens
gctgaggcgggcggatcacctgaggtcaggagtttgagaccagcctgaccaacatggagaaaccccatctctatcaaaaatacaaaataggccaggcgtggtggtgcatgcccgtaaccccagctactcaagaggctgaggcaggagaatagtttgaacccgggaggcagaggttgtggtgagctgagatcgtgccattgcactccagcctgggaaacaagagtgaaactccacctcaaaaaaaaaacaaaataaagaactaattcactgtgactcctacaaccaaagttaaactgaaagagctgctttttatctcccaaatccccatgaagcagccaggatggtaaatgagatgccctctccttccagcagcctccaaggtcggagggaccaaggggcttggaagtcaagaccaagatcaaaccaggtctctcccctgctccacggtcaaccgtggctccctactgctcccagaagaaagcccaactccctgcctgcctgccggtcc

SEQ ID NO: 334267 - DNA, 830 bp, Homo sapiens
tgcagtcaaattgttgtctcagggtccttctgaagacccaatctaagacagaagccttctcagacagggtgacatctttccgagctaggatttgagaggtgtttggcacagagaaggagagggactgccttcttgcctatgctggaagcctcttttgtatttgagtcaaaaaaaggctcatgtcctccagctggatttggggtttatctgagccaaacccagttgagagaggtcccaggcatgatctgatacaatagagtccaagctctgtcattagagcctgagtctttaggtctctcctctccatctgcactgcccttgactaaggtcaaacttcatcagctttcactgagactatttctcaacttttgcacttgtcttcatgaatcctccacataagcagtcaaaggaatacttctaaaatgcacttcagattatgtcactcccctgctcaaacacctcctctggctccccatggcccccagactcacagtcatggcattcaaagcttatcagtgtgtcccagtacaggcttcccacattccccactttctctgttatcttggacacagttctctcagcagtctacgctgcttgtcattctctgggcctttgcacatgcttttccttttgccaggaacattcttctgcttcttcatctagtgaattatgactcatcttgtaaaggccatttttatcctgtgacccccaccctaaagtcctggtcagttccaatatctatgctctcacagcactcggttcacagaagagcagaacagcacagcggttaagaacatgggcttgttgcaagacttcctggatttgaacta

SEQ ID NO: 334268 - DNA, 617 bp, Homo sapiens
ccccccccccacccccccgcccgcaattagatttcaagcaatccagagccctatacaccagggtcattaagagcagttaaagctgaaaacaacctgctctgtgaatggtcttcccctaattcccattcatctgatgccagtgcctcctgagagagggtgggggctatctctgaatcatccagaatgagaaaggttctgtgtattcaaactcatactctatacagtctgacgccatgctgtgcagtgaccacaggtttctcggtgttattaggagtcttggaaaggagatgggtggtaaatggataacaacagcagagccaagaaactactgctgaggtgggtttcaatattgatgtgtttctctctagcccttatttacagagcacagagctagtacttatataagaatgagtcccttcctttcttaatagcctcttcccaaaagactgttttaagtcaagaattccagttgagttggttgtaagaatagatatcctttcccacattatcattttaggtaggaactaacagattccattgatgctttgaagcagcgatctttggaggtttttaaaaatagtaccataatgcaaattaggttatgtaagctttacagc

SEQ ID NO: 334269 - DNA, 536 bp, Homo sapiens
gcgtggacccggaaggcggaggaaaggggccggggacctgtgcgagttttgttaacactcctccctcttgttgaggacctggatagaactgtttgtggagaccattgcaaaagatgcctactgttgcgctcagcagggaaaaaggaaaacccttcagaggagagacttggataatgcaatagaagctgtggatgaatttgcttttctggaaggtactttagattgattgccgagcggggcagttttgtgagccttcatctgaagccttcagttcacccctctgcacaggcctcagctttgaagaacggagtctttgcacttacacacactcttcctgttctgccttcacctatgccgggataagcagagatctcatcaattagctcttctctgcaaggtcttccactatttctgtctgtcttccatatcaagcctggatgcagctgctgctgcttagagcagagatgaagaaagtgttctgcataagtggcttcctgaatgatgaggaccagaataaaggtttttgatcaacctca

SEQ ID NO: 334270 - DNA, 866 bp, Homo sapiens
  misc_feature (85)..(85): n is a, c, g, or t
agtcggcggccgcgcgcagcacgctcaaggccgggatggcggcggcggcggcggcaggaagcgggacgccccgagaggaggaggnacctgctggggaggcagcggcctcgcagccccaggccccaacgagtgtgcctggggctcgtctctcgaggttgcctctggcgcgagtgaaggccttggtgaaggcagatcccgacgtgacgctagcgggacaggaagccatcttcattctggcacgagccgcggaactgtttgtggagaccattgcaaaagatgcctactgttgcgctcagcagggaaaaaggaaaacccttcagaggagagacttggataatgcaatagaagctgtggatgaatttgcttttctggaaggtactttagattgattgccgagcggggcagttttgtgagccttcatctgaagccttcagttcacccctctgcacaggcctcagctttgaagaacggagtctttgcacttacacacactcttcctgttctgccttcacctatgccgggataagcagagatctcatcaattagctcttctctgcaaggtcttccactatttctgtctgtcttccatatcaagcctggatgcagctgctgctgcttagagcagagatgaagaaagtgttctgcataagtggcttcctgaatgatgaggaccagaataaaggtttttgatcaacctcaaaaaaaaaaatttattttttatattatataatatattttagaaaaaaaatcttgaggggggccccggtccccaaattccccttatagggagccgttttacgcgcgctaattggccgtggttttacaactttgggactgggaaaaccctggggttcccccatttaatt

SEQ ID NO: 334271 - DNA, 703 bp, Homo sapiens
gcgtggacccggaaggcggaggaaaggggccggggacctgtgcgagttttgttaacactcctccctcttgttgaggacctggatagaactgtttgtggagaccattgcaaaagatgcctactgttgcgctcagcagggaaaaaggaaaacccttcagaggagagacttggataatgcaatagaagctgtggatgaatttgcttttctggaaggtactttagattgattgccgagcggggcagttttgtgagccttcatctgaagccttcagttcacccctctgcacaggcctcagctttgaagaacggagtctttgcacttacacacactcttcctgttctgccttcacctatgccgggataagcagagatctcatcaattagctcttctctgcaaggtcttccactatttctgtctgtcttccatatcaagcctggatgcagctgctgctgcttagagcagagatgaagaaagtgttctgcataagtggcttcctgaatgatgaggaccagaataaaggtttttgatcaacctcaaaaaaaaaaatttattttttatattatataatatattttagaaaaaaaatcttgaggggggccccggtccccaaattccccttatagggagccgttttacgcgcgctaattggccgtggttttacaactttgggactgggaaaaccctggggttcccccatttaatt

SEQ ID NO: 334272 - DNA, 682 bp, Homo sapiens
  misc_feature (85)..(85): n is a, c, g, or t
agtcggcggccgcgcgcagcacgctcaaggccgggatggcggcggcggcggcggcaggaagcgggacgccccgagaggaggaggnacctgctggggaggcagcggcctcgcagccccaggccccaacgagtgtgcctggggctcgtctctcgaggttgcctctggcgcgagtgaaggccttggtgaaggcagatcccgacgtgacgctagcgggacaggaagccatcttcattctggcacgagccgcggaactgtttgtggagaccattgcaaaagatgcctactgttgcgctcagcagggaaaaaggaaaacccttcagaggagagacttggataatgcaatagaagctgtggatgaatttgcttttctggaagaaatgaagtgttaaaagagaagtatacaacaagtaacgtggaagctctgatgagaaaagaatcaattctgtctgtgaggattatggaccagaccctgagaagataatctttgaagtacccttggggcataaatggaatttcacttcaacggttataaaataattagtcttggctgcaacacctttttttttttttggagagggagtttcgtgcttgtggcccaggctggagtgtaagggcgtgatctgggctcactgcaacttccacctcccaggttcaagcgattctcctgcctcagcctcctgag

SEQ ID NO: 334273 - DNA, 821 bp, Homo sapiens
  misc_feature (85)..(85): n is a, c, g, or t
agtcggcggccgcgcgcagcacgctcaaggccgggatggcggcggcggcggcggcaggaagcgggacgccccgagaggaggaggnacctgctggggaggcagcggcctcgcagccccaggccccaacgagtgtgcctggggctcgtctctcgaggttgcctctggcgcgagtgaaggccttggtgaaggcagatcccgacgtgacgctagcgggacaggaagccatcttcattctggcacgagccgcggaactgtttgtggagaccattgcaaaagatgcctactgttgcgctcagcagggaaaaaggaaaacccttcagaggagagacttggataatgcaatagaagctgtggatgaatttgcttttctggaagtggtgaaatcgcctgaagatgtgatgcatttctcaggatgtatccttgttgttgagcgacacatgtattttgattgaatagcttagcaaaagccatgtatccttattctcccagggtgttctcattacctccttcaagccttattacctttagaaatatcttgatttattccactcttttttactcctttgttctgcatctccctgtcaacctaggcccctggtccttttgatagatattttttaaatgtcttattagatagatagactaccatggccaactctatgtctagactattgagcattcttttaatttgcagatttttcttcagcctctctttccacctactcatttttcttaaaattaacttttgttagtcctacctaaggcaggcactccttgtgacagactttctgtaagttctgcagtcaaaaatgtttggagcc

SEQ ID NO: 334274 - DNA, 518 bp, Homo sapiens
  misc_feature (85)..(85): n is a, c, g, or t
agtcggcggccgcgcgcagcacgctcaaggccgggatggcggcggcggcggcggcaggaagcgggacgccccgagaggaggaggnacctgctggggaggcagcggcctcgcagccccaggccccaacgagtgtgcctggggctcgtctctcgaggttgcctctggcgcgagtgaaggccttggtgaaggcagatcccgacgtgacgctagcgggacaggaagccatcttcattctggcacgagccgcggaactgtttgtggagaccattgcaaaagatgcctactgttgcgctcagcagggaaaaaggaaaacccttcagaggagagacttggataatgcaatagaagctgtggatgaatttgcttttctggaagcattattcacaataaccaagatatagaatcaacctgtgttcctcaatggattaatagataaagaaaatgtgataaatatacacaatggaatatgattcagctttaaaaaaggagatgctttcatgtgtgacaacatgggatga

SEQ ID NO: 334275 - DNA, 667 bp, Homo sapiens
atctccagggcctcgtacagaacttgtaggagtctttagtgaatgagggagaatactgggaagagggtagcggaatggatcttcatgaagtccaggacaatcttagcttccagaacattttcttgccccgagcctttcttctccctttctgcccccacccacaaaccggagccctcacctcctcagtgtgttagaacccattactaaaactttgcttttttacttcacaggaactgtttgtggagaccattgcaaaagatgcctactgttgcgctcagcagggaaaaaggaaaacccttcagaggagagacttggataatgcaatagaagctgtggatgaatttgcttttctggaaggatattgcgctcatcttcaaggaatgaaccacagtggtctaagccaatgaagtaaatctatcctcctttgccagtgattgatgtaccgatggccatgtgatccagccctagtcttttgagggcttccggaaagatctaatcccttggtgaaaagagaagtccatatatgccctcaccacaacctcaaaatttcctaaaagaaaagaaatccaccttacaagctaagctcttgcatatgaagaagaagtccctgaggactgggaatagctaagaaaatctctgctcttttgactttcaccatgaggagggg

SEQ ID NO: 334276 - DNA, 662 bp, Homo sapiens
  misc_feature (85)..(85): n is a, c, g, or t
  misc_feature (628)..(628): n is a, c, g, or t
agtcggcggccgcgcgcagcacgctcaaggccgggatggcggcggcggcggcggcaggaagcgggacgccccgagaggaggaggnacctgctggggaggcagcggcctcgcagccccaggccccaacgagtgtgcctggggctcgtctctcgaggttgcctctggcgcgagtgaaggccttggtgaaggcagatcccgacgtgacgctagcgggacaggaagccatcttcattctggcacgagccgcggaactgtttgtggagaccattgcaaaagatgcctactgttgcgctcagcagggaaaaaggaaaacccttcagaggagagacttggataatgcaatagaagctgtggatgaatttgcttttctggaaggtactttagattgattgccgagcggggcagttttgtgagccttcatctgaagccttcagttcacccctctgcacaggcctcagctttgaagaacggagtctttgcacttacacacactcttcctgttctgccttcacctatgccgggataagcagagatctcatcaattagctcttctctgcaaggtcttccactatttctgtctgtcttccatatcaagcctggatgcagctgctgctgcttagaggagggncttagagtcgactagatgcaagttgatgcgttaa

SEQ ID NO: 334277 - DNA, 382 bp, Homo sapiens
ggagccattgtggctccggccggttgcgctcagcagggaaaaagggcttttctggaaggtactttagattgattgccgagcggggcagttttgtgagccttcatctgaagccttcagttcacccctctgcacaggcctcagctttgaagaacggagtctttgcacttacacacactcttcctgttctgccttcacctatgccgggataagcagagatctcatcaattagctcttctctgcaaggtcttccactatttctgtctgtcttccatatcaagcctggatgcagctgctgctgcttagagcagagatgaagaaagtgttctgcataagtggcttcctgaatgatgaggaccagaataaaggtttttgatcaacctca

SEQ ID NO: 334278 - DNA, 583 bp, Homo sapiens
tgcccagcttgttacactaatccagcttctgaggtcccctgatatactcattgctctttgtatgtttaggtactttagattgattgccgagcggggcagttttgtgagccttcatctgaagccttcagttcacccctctgcacaggcctcagctttgaagaacggagtctttgcacttacacacactcttcctgttctgccttcacctatgccgggataagcagagatctcatcaattagctcttctctgcaaggtcttccactatttctgtctgtcttccatatcaagcctggatgcagctgctgctgcttagagcagagatgaagaaagtgttctgcataagtggcttcctgaatgatgaggaccagaataaaggtttttgatcaacctcaacctcagtccagtgtgttttataatctcgcctttgttcctaccctgtgactggagagtcaccatacctggtcacagaccttcctgatcttccctgccagccattctaacatacagtcctttcattaattttgttcttttatttttccagcacatcaccagaaagtggttccagaatttatggaacaccac

SEQ ID NO: 334279 - DNA, 699 bp, Homo sapiens
  misc_feature (85)..(85): n is a, c, g, or t
agtcggcggccgcgcgcagcacgctcaaggccgggatggcggcggcggcggcggcaggaagcgggacgccccgagaggaggaggnacctgctggggaggcagcggcctcgcagccccaggccccaacgagtgtgcctggggctcgtctctcgaggttgcctctggcgcgagtgaaggccttggtgaaggcagatcccgacgtgacgctagcgggacaggaagccatcttcattctggcacgagccgcggaactgtttgtggagaccattgcaaaagatgcctactgttgcgctcagcagggaaaaaggaaaacccttcagaggagagacttggataatgcaatagaagctgtggatgaatttgcttttctggaaggtactttagattgattgccgagcggggcagttttgtgagccttcatctgaagccttcagttcacccctctgcacaggcctcagctttgaagaacggagtctttgcacttacacacactcttcctgttctgccttcacctatgccgggataagcagagatctcatcaattagctcttctctgcaaggtcttccactatttctgtctgtcttccatatcaagcctggatgcagctgctgctgcttagagcagagatgaagaaagtgttctgcataagtggcttcctgaatgatgaggaccagaataaaggtttttgatcaacctca

SEQ ID NO: 334280 - DNA, 750 bp, Homo sapiens
  misc_feature (85)..(85): n is a, c, g, or t
agtcggcggccgcgcgcagcacgctcaaggccgggatggcggcggcggcggcggcaggaagcgggacgccccgagaggaggaggnacctgctggggaggcagcggcctcgcagccccaggccccaacgagtgtgcctggggctcgtctctcgaggttgcctctggcgcgagtgaaggccttggtgaaggcagatcccgacgtgacgctagcgggacaggaagccatcttcattctggcacgagccgcggaactgtttgtggagaccattgcaaaagatgcctactgttgcgctcagcagggaaaaaggaaaacccttcagaggagagacttggcaactggggatttgatttctgactcttgtctggctgggaaccctcacctggataatgcaatagaagctgtggatgaatttgcttttctggaaggtactttagattgattgccgagcggggcagttttgtgagccttcatctgaagccttcagttcacccctctgcacaggcctcagctttgaagaacggagtctttgcacttacacacactcttcctgttctgccttcacctatgccgggataagcagagatctcatcaattagctcttctctgcaaggtcttccactatttctgtctgtcttccatatcaagcctggatgcagctgctgctgcttagagcagagatgaagaaagtgttctgcataagtggcttcctgaatgatgaggaccagaataaaggtttttgatcaacctca

SEQ ID NO: 334281 - DNA, 465 bp, Homo sapiens
  misc_feature (85)..(85): n is a, c, g, or t
agtcggcggccgcgcgcagcacgctcaaggccgggatggcggcggcggcggcggcaggaagcgggacgccccgagaggaggaggnacctgctggggaggcagcggcctcgcagccccaggccccaacgagtgtgcctggggctcgtctctcgaggttgcctctggcgcgagtgaaggccttggtgaaggcagatcccgacgtgacgctagcgggacaggaagccatcttcattctggcacgagccgcggaactgtttgtggagaccattgcaaaagatgcctactgttgcgctcagcagggaaaaaggaaaacccttcagaggagagacttggataatgcaatagaagctgtggatgaatttgcttttctggaaggtgagttccctctcagtgggcaatcatttccgcctgtcttttgcatgttgatgtgaaattcaaaatctcataaaacggatgcctgcttct

SEQ ID NO: 334282 - DNA, 465 bp, Homo sapiens
  misc_feature (85)..(85): n is a, c, g, or t
agtcggcggccgcgcgcagcacgctcaaggccgggatggcggcggcggcggcggcaggaagcgggacgccccgagaggaggaggnacctgctggggaggcagcggcctcgcagccccaggccccaacgagtgtgcctggggctcgtctctcgaggttgcctctggcgcgagtgaaggccttggtgaaggcagatcccgacgtgacgctagcgggacaggaagccatcttcattctggcacgagccgcggaactgtttgtggagaccattgcaaaagatgcctactgttgcgctcagcagggaaaaaggaaaacccttctctgcaaggtcttccactatttctgtctgtcttccatatcaagcctggatgcagctgctgctgcttagagcagagatgaagaaagtgttctgcataagtggcttcctgaatgatgaggaccagaataaaggtttttgatcaacctca

SEQ ID NO: 334283 - DNA, 541 bp, Homo sapiens
gaggataaaactgctaactgaggggcgagctgctaactcagggcgagctgctaactcagaagcgagctgctaactcaggggcgagctgccgaactgtttgtggagaccattgcaaaagatgcctactgttgcgctcagcagggaaaaaggaaaacccttcagaggagagacttggataatgcaatagaagctgtggatgaatttgcttttctggaaggtactttagattgattgccgagcggggcagttttgtgagccttcatctgaagccttcagttcacccctctgcacaggcctcagctttgaagaacggagtctttgcacttacacacactcttcctgttctgccttcacctatgccgggataagcagagatctcatcaattagctcttctctgcaaggtcttccactatttctgtctgtcttccatatcaagcctggatgcagctgctgctgcttagagcagagatgaagaaagtgttctgcataagtggcttcctgaatgatgaggaccagaataaaggtttttgatcaacctca

SEQ ID NO: 334284 - DNA, 422 bp, Homo sapiens
cacctgccgggttcagcatctgctgggctcccagcacctgtccttcatcctttctgtgcagagaagctcctcttcctgcatatgtgtaactgagaaacagcagggctcctggcccctcgtcctcaccctgatcaggggggctctcatgggggctggcttcctcctcacctatggcctcacctggatctactataccaggtgtggaggcccccagcagagcagggctgagaggcctggctgagcccctcccgctcaagacagaactgaggtgtggacacttagccctgtgggacacatgcaggacatcactgtcagcttctttctggaagctcacatcccactgactacccctcttttccttcctgccccataccccttctacttattcccctctgcttgtgagtcttgccccaccacacctg

SEQ ID NO: 334285 - DNA, 833 bp, Homo sapiens
acttccgcctcccaaattcaagctattctcctgcctcagcctcccgagtagctgggattacaggtgcccgccaccacgcccagctaatttttgtatttttagtagagatggggtttcaccatgttgaccaggcagatcttgacctcctgacctcaggtgatccgcctgtctcggcctcccggtgagtcacggtgcctggccaagaactgtttcttgttggctctggtgctggtgacttagaacccgccagctcctggagaaaggggctgggccgcccaccctgtgtagctttcccaaagacagagtcaaacgtctcctggagaacagaggcttcccttcgtctttggtcatttgtcctctagctgggggtaccccctggtggaaaggcacaggtcccttgctccccaggtggcaacgcaggccagacacggccctggcacagctctcctgggtgttggctcaggacagccctgtttccaactggttaggcggtgaggggtggtggccctttggttccaggttgaaactgcccatgtggtgctgatttagcagactggggaggctctttttgtaggcaggttcttttctttccccagctgctggacctgggagttggaagagaagttgcacccattttaggggtaacagatattttctgttgctcttggttggattgggaagtgaattgaagggaggtcacgtttcaggggtgccttgggatgtctgtcagtgattttcttttctttcttaatttctttttctttctttttttttttttttttgagacacactccagcctcggtgacagcgcaaggctccgtctcaataattta

SEQ ID NO: 334286 - DNA, 842 bp, Homo sapiens
cgcccctcgctcggctgctggaggcgagggcttcggaagtcttcatgctagtctcgtggggttccgcggtgtcgtcgctggctgtgcgcgtcatttccgggcgtcacgtaacggagtggccaacggcctgcagagcaacatgcccaagttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaa

SEQ ID NO: 334287 - DNA, 734 bp, Homo sapiens
  misc_feature (9)..(9): n is a, c, g, or t
  misc_feature (28)..(28): n is a, c, g, or t
gtaacggangcgcaacctggccaggagnaacatgcccaagttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaa

SEQ ID NO: 334288 - DNA, 922 bp, Homo sapiens
cgcccctcgctcggctgctggaggcgagggcttcggaagtcttcatgctagtctcgtggggttccgcggtgtcgtcgctggctgtgcgcgtcatttccgggcgtcacgtaacggagtggccaacggcctgcagagcaacatgcccaagttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaacacaccaccacccccccacacaaaaccccgggccacaccgcgggggccacacggcgcctcaagcgcccgtccaaacggcc

SEQ ID NO: 334289 - DNA, 507 bp, Homo sapiens
acggctaggtacgaggctgggtgtgaatcggccgaggcactccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaa

SEQ ID NO: 334290 - DNA, 425 bp, Homo sapiens
ttgaagtcccatcaaactctccctaaatcgtattttctgactccctttttctccctcttctttgttttgtcctgcagctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaa

SEQ ID NO: 334291 - DNA, 408 bp, Homo sapiens
  misc_feature (9)..(9): n is a, c, g, or t
  misc_feature (28)..(28): n is a, c, g, or t
gtaacggangcgcaacctggccaggagnaacatgcccaagttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctggtaagtttgaatgtctgtcttt

SEQ ID NO: 334292 - DNA, 751 bp, Homo sapiens
cccacgcgtccgtcgacccacgcgtccgccaacggcctgcagagcaacatgcccaagttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaa

SEQ ID NO: 334293 - DNA, 1053 bp, Homo sapiens
gagtggggccccgaaatctgagggtgatcgtagtcactagttgtggcccccatgcaggagcggagagcgggttctggtttctgaaacctcgagggatgggagagtatctgggccgggtggacggaggcagggagatggagagcgctagacaccccattttagagtgcagatggatcccgcttaaggcaacaaaaaaaagcctggtttatgtgtcgacgctttgatgcttttgagtcgtgaggcggtctggctttttgttttgtttgtttgttttgtttttatcttccatgaacagcgcttccgtggatgggcatctcagtggttgtcgtctttttctcttcctttcacctcttttcaggttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaa

SEQ ID NO: 334294 - DNA, 799 bp, Homo sapiens
cgcccctcgctcggctgctggaggcgagggcttcggaagtcttcatgctagtctcgtggggttccgcggtgtcgtcgctggctgtgcgcgtcatttccgggcgtcacgtaacggagtggccaacggcctgcagagcaacatgcccaaccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaa

SEQ ID NO: 334295 - DNA, 1048 bp, Homo sapiens
cgcccctcgctcggctgctggaggcgagggcttcggaagtcttcatgctagtctcgtggggttccgcggtgtcgtcgctggctgtgcgcgtcatttccgggcgtcacgtaacggagtggccaacggcctgcagagcaacatgcccaagttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaaaaaaaaaaaaaaaaccccaacccgtaatgtacttctaccatctttggcgggcccctccattaaagggctagacctcgcacggatttttaccggagcggcctagaaattacctgctagcttaattcagttctaccaaaaattacctcgtccagagcggcccaaattccccgaggcacggacgtatccttaaaagttccttaaatatc

SEQ ID NO: 334296 - DNA, 905 bp, Homo sapiens
cgcccctcgctcggctgctggaggcgagggcttcggaagtcttcatgctagtctcgtggggttccgcggtgtcgtcgctggctgtgcgcgtcatttccgggcgtcacgtaacggagtggccaacggcctgcagagcaacatgcccaagttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaaagtgtgttccctttttcctcctctctgtgttctctgtgtattataaaagaaatgaaacattcc

SEQ ID NO: 334297 - DNA, 746 bp, Homo sapiens
  misc_feature (3)..(3): n is a, c, g, or t
  misc_feature (8)..(8): n is a, c, g, or t
  misc_feature (31)..(31): n is a, c, g, or t
  misc_feature (33)..(33): n is a, c, g, or t
  misc_feature (117)..(117): n is a, c, g, or t
cancgggnacagggtggattggcaaccgttnanatgccggttttaagcatctttcggcaaatggcgcttcgagtctgggtgccttccccgcagcttgtggaacactctgtccagttnagagaagccacttcgctgggacagtcatctttcttgcatgctttgctggcaggcaggttttgaagctgaacagaaggtctcaggaagctccaggaagcttgccatcagccatgcgctgctggaaatgctgactcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaa

SEQ ID NO: 334298 - DNA, 302 bp, Homo sapiens
tgcttttgagtcgtgaggcggtctggctttttgttttgtttgtttgttttgtttttatcttccatgaacagcgcttccgtggatgggcatctcagtggttgtcgtctttttctcttcctttcacctcttttcaggttttattgtgactactgcgatacatacctcacccatgactctgtaagtggcatatctattcatagtttcaaaaagccttatgtgtaataattaaatgagttttgtgttttttttaagttgcaagttgtgctttcccacctgctgaggtttaaggtctactccttgaa

SEQ ID NO: 334299 - DNA, 758 bp, Homo sapiens
  misc_feature (15)..(15): n is a, c, g, or t
  misc_feature (21)..(22): n is a, c, g, or t
  misc_feature (28)..(29): n is a, c, g, or t
aattaaggctaagtncgaggnnggggtnnaatcggccgagcggctgcagagcaacatgcccaagttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaa

SEQ ID NO: 334300 - DNA, 821 bp, Homo sapiens
  misc_feature (15)..(15): n is a, c, g, or t
  misc_feature (21)..(22): n is a, c, g, or t
  misc_feature (28)..(29): n is a, c, g, or t
aattaaggctaagtncgaggnnggggtnnaatcggccgagcggctgcagagcaacatgcccaagttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaaagtgtgttccctttttcctcctctctgtgttctctgtgtattataaaagaaatgaaacattcc

SEQ ID NO: 334301 - DNA, 923 bp, Homo sapiens
tagctagtacgaggctgggtgttaaatcggccgagggcgataccatacctctatcccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaaaaaaaaaaaaaaaaccccaacccgtaatgtacttctaccatctttggcgggcccctccattaaagggctagacctcgcacggatttttaccggagcggcctagaaattacctgctagcttaattcagttctaccaaaaattacctcgtccagagcggcccaaattccccgaggcacggacgtatccttaaaagttccttaaatatc

SEQ ID NO: 334302 - DNA, 749 bp, Homo sapiens
  misc_feature (19)..(19): n is a, c, g, or t
  misc_feature (24)..(24): n is a, c, g, or t
  misc_feature (45)..(45): n is a, c, g, or t
  misc_feature (53)..(53): n is a, c, g, or t
cagctgttgtatctaggtncgagnctgggtggcgctgcagagcanggtgccgnagttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaa

SEQ ID NO: 334303 - DNA, 942 bp, Homo sapiens
gagtggggccccgaaatctgagggtgatcgtagtcactagttgtggcccccattgcagatggatcccgcttaaggcaacaaaaaaaagcctggtttatgtgtcgacgctttgatgcttttgagtcgtgaggcggtctggctttttgttttgtttgtttgttttgtttttatcttccatgaacagcgcttccgtggatgggcatctcagtggttgtcgtctttttctcttcctttcacctcttttcaggttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaa

SEQ ID NO: 334304 - DNA, 717 bp, Homo sapiens
actttgacatgaacattgccagggttctattgtgactactggatacatactcacccattggatctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaa

SEQ ID NO: 334305 - DNA, 572 bp, Homo sapiens
ataggctggtgctactgcttgggatgtcttcctcctcctcctcctcctcctgtcctctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaa

SEQ ID NO: 334306 - DNA, 316 bp, Homo sapiens
gggtagcctgttaatattctcattttgcagtgtgtaaggtacctgttcctgtctgtggtatgataattgtcaattgggtactttgggttagttttccaatctttggtcttctttaaaggggagagagtgggagatttccagcagtgcagatccccggtcaaaggagaaatgtgcaggagttaagatgagctgcccatctatctaaccatctatgtatctgtctctcaagtgggtggatgggggttgctatcttggctgtataaagaatcctaaaaaccttgtctcataagctagaggtttcctgatgggtttaact

SEQ ID NO: 334307 - DNA, 1179 bp, Homo sapiens
cttactggctgtgtgccagtgaacaagctttttatgcatcagttccctttcctcacctgtcaagtagagatcataacatagaacgacagggataataatatatgataatatgatcaaagtgtagggttgttaggagaataagatgtaatgatacatgtgtagttcttggagcaatgccaggcattacagtaagcactcgataaatattagctctattctaatcaaatacctatccagaaacacacagaatccttactgccaaaaatgcttatgtgccttccttgaaaaatgggtaagataaacaagagatatcttagaaaactaggctcaacagataagaaaataagcaccctgctttcccctgtagtcgttccagtgaggcctctgcagcctcctgggtggctttggagccctgaacacctgggcacaaatcttggcttccttccttccatgtgagggtcctgtaaaagtcgcttcacctcctggagttacattatcctcatctgtcaagtgtcggaagctggaagttggcaaagaaatgcaaagcacattggaaatggaaaagaaagaaggaggcatccattgataaacactaagttacttcttcatgtccagaggactctacatgccacatgctcatcttgcaaaacagagataaccacctgaatcctttgaagactggaattctgcgagtttaattttagtattcatgatcttaattgtgaataccagatgccacttccatgcttaggatgatgaagctaaacaaaactgaagcaggagctgccgtgggagtcacgttctgaaagagatgggagtcacgtgactctcctacatcagctgcttgccctggagccattcattcactagcaagcatgcatcaatgccttcatgctgaagatgtgaggctgcagctggcacgagctgggggtggtaaggaaccaggaggagtgacataattatgaccctatgaggctaccaatccaacagaggtgatcacatcccttaacatatcaaataggaagagcagggctgagcacggtagctcacgcctgtaatcccagcactttggaagtccgaggcaggtagatggcttgaggtcaagagttcaagaccagcccagccaacatggtgaatccccatttctactaaaaacacaaaaagtagccagacgtggtg

SEQ ID NO: 334308 - DNA, 327 bp, Homo sapiens
ctcccaaagtgctcgggaatctgtatttttactatgatcctcaggtgatctttgtgcctagtagtggcctgacaatgaatcttaggaaactctgatttaaatagactcaatcaaataatttccatatcacaaatatgagtgtcagaggagcctgggctgctcctttgctggatatctgtactctgggcaaagggagagagcagataatatgccgggtggttaattatgttggcatttattcattctgaaatgtttacaaatgtaattagaagccagattaggtatgatgctcactgacctttaaggagagcttggcatcaaacaacc

SEQ ID NO: 334309 - DNA, 429 bp, Homo sapiens
atacatgcacctaactaacactggagttcccaaattaataaaacaattactaatatgcctaagaaatgagacagacagcaacacaataatagtgggggactttaatactccattgacagcactagacaggtaatcaatatagaaagtcaaaacagaaacaatggattttaaactataccttggaatacatggacttaacagatttatacagaacattccatcctacaactacaaaatacacattctattcaacagctcatggaactttctccaaggtagaccatgtgataggccacaaaatgagcctcaataaatttcagaaaattgaagttatatcaagcactctctcagaccacagtggaataaaactggaaatcaactccaaaaggaatcttcaaaaccatgccaacacagggaaattgaataacc

SEQ ID NO: 334310 - DNA, 342 bp, Homo sapiens
ggccctttttctgcaaacgccgagggacatccgttgtataataaggccagcctgggtcgagagacgagaaacgctaccagaaagatatttctggtctctctgacctaggaggaacaaaaggccgagccttcatttgaattatgtttcagcagtggcctcgcacgtttattcgcctgcgttaggccggcaggcctgttgatttcgtaggtcgacagaggagaggggaaaaaaggccagtagaagcaatcttaaaggcacttgcaagcaagccccggttgggaactccaaaatgggagtagagtggtccttgatggaaggagcgtttaagagtgtcgcctagcc

SEQ ID NO: 334311 - DNA, 764 bp, Homo sapiens
aaacatctttcttatccccttgctttccctgggagacagtcactctatttatttcacccgcctctctgtgccttcatttactagatgtccagtagtgctaggcagtctgctaacctctgatgaacagggcacatggaccctgtccgagggcacacggtggataccaatgccatcacaagttctgggaacaggtttgaagcaagtataccaatactgatgaatacactgtgcaagctggaaaagtgatacttgagctgaggattgttcaaatgattaggaattcactagaagggaagggggcccaggtagtgagtacagatgagtcccagaagcaggaggcagaaggaggatggaggtgtgcctggggagctgctgatggttctgtgtggttgaaatgtgtataggtctttgtgtgtgtgtgtgtgtgtgtgtgtgtgtgtgtgtgtagcacacgatgggcaaggaagcagagagggaagaaggaaatcacagatgtgctggaaaagaatactagagccaaattgtaaagggccttgtgtgctgtgtgctggagcttaacctgtattctttgggccatgtcgaatcacattaaatgtgaccaagcagggagctgtggcatgtgtctgtggtccatcccgtactagggaggcttgcttgagcccaggagttcgggggcgcagtgagccatgaccatacctgtgaatatccactgcactccagcctgggccatgggccatgtagtgagaccccatctcttaaaaaaa

SEQ ID NO: 334312 - DNA, 585 bp, Homo sapiens
atctctggagagggtgaatgagagaccccaatcttaggaacacaagtcacaactgaagcaagacaaaatgtcttactgaaaaagaggaaaattatgtgaaattctgctcaggatgcagtagactatctcccaggagaaaatggaggtgacagattacttaatgtgtccaaccatattaagagctgtttcagatttgttaaataattgtaaatgaattaataacaagaaaaaaattttaaactgggataattatctggaaaaacaaaatataattagtgaattttgtgactcagttgtgaaaaatatttgcatagtcttaataaacactaaactacccccaaaatctgataccctataaagatgagaaaaagggaagtatgtataaaagcctgtgggcagtagagagattaagataactaatcttcatccttcttagatggaagtcagtagctactatctaaaatgaaaacccaacaaaaagcagaataactgacttagaaaaatgaagacaaatatcagaacaaataactaaaagaacggaaactgactgccttgtaaagattggtaattggaggtgaagagaga

SEQ ID NO: 334313 - DNA, 916 bp, Homo sapiens
ctgtgtgtactcagtgatagatttcagagacagaaatacctcagcctccagcagatgcaagaactttacagcatcctgaatcttagctacaaacaggttaagacttggttccagaaccagagaataaaatataagaggtggcagaaaaacagctgcccaaagaatagcaatggtgtgactccaaaggcctgagcacctacctaccccagcctctattcttcctgcctccaaggatgcttggcgaacatgtctgggaacctttcaatgcagagcaaccagacctgtagcagttcggcctggggcaaccagacctggaacatccagtcctagaacagccattcctgaacactcagacctggtgcacccaatcctggaacaatcaggcctggaacaatcccttctatagctgtggagaggaatctctgcaagtcctgcatgcggttccagcaaattcttctctcagtgacttggaggctgccttggaaactgctgaagaaagctacaatggaatacagcagaccactaggtattttagtactccacaaaccatagatttattcctaaactattccaagaacatgcagcctgaagatatgtaaagatgagtgaaactgatattactcaatttcagtctgggcactggctgaatccttcctctcccctcctgcctccctcataggattttacttgtttggaagctacatgttctgccttcatatctttgtttcctttatgcctatcaagtcgattttgtggagggtggggtatgattggagccaaatcagagagttttctttttttcctatgggatctttctggagaaaaaaggttttaataaccttggctgctaaggacaacatgatagaagctgtctctggctatagataagtagatataatactagtttgaatatctt

SEQ ID NO: 334314 - DNA, 517 bp, Homo sapiens
ggaggaagttaggaaattactggtttgcctaagggaggcagggaaggcttacaggagtacagggaacccgaattttgactttactttcctatgctccacctaagcagaaggaagagtatgcacaaaggcacaggggcaggaattaatacagtacaaggaagcccagggtgcgctggcaggaagagtccgtatgctggaaaagcacgttgggccttaaagttacatttcatcctacaagccccaggaggctgggtggaacaaaaatcatttggtagacaatttggtataaggatttaaattaatccttcttgatcttcttttcttttttgagacagagtgtcacactgtcactcagactaggatgtggtggtacaatcacggctcactgcagactcgacctcctgggctcaagcaatcctcccacctcagcctcctgagtatttgggaccaaaggcggatgccaccacgcccagctaattttttttttttttttgagacggagtctcactctgtcatc

SEQ ID NO: 334315 - DNA, 345 bp, Homo sapiens
tttctcctcttccagcttctaatcactgaagttccctagggctctgtccttagatatttcttccctacctacactccctttaaagatgatatcatccaatctcttgcctttaaatgtcctctatatgctagggatcctcacctttatgttaccactccagacctcctccctagattccactcccatataactacctactcaatatctccatttatttatctaataggactctcaaaactaattatttcttcttatcccacagtctgcttctcataaagtactcctcatctcggtaaacacccactttatccttcccattgctcagaccaaaatctttggagctat

SEQ ID NO: 334316 - DNA, 515 bp, Homo sapiens
aaaaaaaagaaaagaaaagctatctgatatggccatagaagtgagttgctgaagaaaagttaaggtgcatataattggagatcaatactgctaggtctaaaatctttccagtactgaccattcctaaaaggaaatgcagtgtagcttatttagtctgccagacattattttttcaaatgctaacttcacatcattactgataggctaatatttgtatcataaacttttatggtaaagctcagtaaataatttttgagagtttatgtatttaacgtttttgagcacatatatatatatgccacatagtgggcattagagatacaaagatgagtaagacatggcttcagtttgtgggaagcttcagcgattcctattctaatataagaagcatgagtaggatcactaactgtaacctatttctaaattggactacttgtctggcattgcgggtgatgtgaaaaaggaagaaaaaaataaaaaaaattttattgctatatgaaatttgttagattttg

SEQ ID NO: 334317 - DNA, 411 bp, Homo sapiens
agattactgcactttgagatacactgagttatttcatctttaaggtcctttacaacgtctttcccttaccttttcattttctgtgatttccttctgcaaacccttacagtgcttacaattcacattctactatcttatgctgtttttataacgaagaattgagttgaagattaaaatccactttagctttaaggcttgcttgatttttctattttgaagtaaaaattatacctacttcctatttttggaggcaatacttcttatcattacaacctgaggaggccaaagaaatatgtaaagttccccttaggtataaaccaaaacatccgcatcactggtcaatccttttgattgtagatgataaccaagaccatggtatgcatgtgtacactggcacaccaatgctcaaac

SEQ ID NO: 334318 - DNA, 226 bp, Homo sapiens
ctgacaccacccagcctggtaatctggctaaaccagttctgccatcccacccaggaacagaaaacagcaggaaaaactcacttccacccctgatgattccatcaccaacctgaccaatcagcactccccacttcccaagcccctacccgccaaattatctttaaaaactctgatctccgaattcagggagactgatgtgaataataataaaacttcaatctcccac

SEQ ID NO: 334319 - DNA, 439 bp, Homo sapiens
tttttttttttccaatatcggctcactgcagcctcaacctcctgggctcaagtgatcctcccacctcagccccccaagtagttgggaccacaggcacatgccactacacctggctaattttttgtattttttgtagagacaaggttttgccatgttgcccaggctggtctcaaactcctgagctcaagcgatccgcccgccttggcctcccaaagtgctaggattacaggtgtgagccactgtgcctggcctctaaacacaaagttcttttgaaggaaaatcaagcagagcagatcactaaacgtattccttaaatatgttctcttccctcccctatcctccataaaatcccacaaataagtatcagatataagtgagatgcttcctaatttaaacccatgatccactgtgtaggaagcaatgacaacagcaagacgtt

SEQ ID NO: 334320 - DNA, 249 bp, Homo sapiens
catttgtgtctcattcatcctcttatcttcagaaccttgcaaaatgctttgcacatagtaagtcttctgtaaacatttgttgaattaactatataaaaatcgtttccagcaaaaacaggtttgagggcaaatatttcagaacattaataagagttatttcttagtgatgggattatgtatgactttcatttttttctttattttttgggaaattgaaaaatattcagtaatgtgcatagtactcttatt

SEQ ID NO: 334321 - DNA, 315 bp, Homo sapiens
attccaatgcaagtttgcctaaagaaacagatatgcggattaagcagacacaaacatttgggccgatgtgataactacatttcctactataaataaataaggcaatctattggtttctgtaatcattctcttggaacctggtaaatggaatcattcttgcctcctttccttttctcatatccaactgtcagcccatcagaaaaatttttgtgagctcttcttcaaaacatatctagaatctgaaccatctttaacacttccaccataagtctaagctaccatcatctctcacatgggcagcctcttttttttttt

SEQ ID NO: 334322 - DNA, 459 bp, Homo sapiens
agacaacttcttgctatgttgcccagcttggacccattggctcactcaagcagtcttcccaccttggctttccaacatgctgggatacagacatgagccaccatgcctggtctctttccgttttttgtgtgtgtgttctctttaatttcttgcatcaattatttattgttttagttgtagcaattttttacttctttgattattaggttaaccttaacttaggttaacttattaagtactttattttatttgtagatactgtaaatgggagtactgttttcatttctttttcagatgggtcattgttgacatatggaaatactgatttttactgatttttgtatattgattttatatcctgaaactttagtgaatttattagttctttttttttttttttttttttttgggaaaaagttttggtcgggcgcccaggggggcaggcccggggggggaccc

SEQ ID NO: 334323 - DNA, 414 bp, Homo sapiens
tttttccacaaggatttaatagtctagtgagggagacaaaaagatcctctcaaaaatgaagtatctgggctgggtgtggtggctcatgcttgtaatcccagcactttgggaggccaaggcgggtggatcatttgaggtcaggagttcaggacaagtctggccaatatggtgaaaccccatctctactaaaaatacaaaaattaggccgggcgcggtggctgacgcctgtaataccagcactttgggaggccgaggtgggcggatcacgaggtcaggagatcgagaccatcctggctaacacggtgaaaccccatctctactaaaaatacaaaaaattagccgggcgaggtgacgggcgcctgtagtcccagctactcgggaggctgaggcaggagaatggcgtgaacccgggag

SEQ ID NO: 334324 - DNA, 429 bp, Homo sapiens
ggagagccctcagcacaagattgatgcatatctattctataattaacaacaatatgaaggaagagattccacggtcaccattaggttccaatccctcatggtcaagactttcttctttttaactagactattttgagcccttttcttctctttgtcttttcagtaactggaaaagaattactaaaactcaccccatgaaaatccctcatgtgcctgaattctttcgaagttaaagattggaactggattaaactcttttcccttaacaacttcttagctacagttttctaagcctttaatgccctttgaattgtctgctctaagttctcttgggttaaagtacaccagtaagaatagccagatttcgtcatatcccatgcaaagctagtgctctccttcatgatctgggagccccgtcccgcggtgcca

SEQ ID NO: 334325 - DNA, 360 bp, Homo sapiens
tgagcagtggtaagcacttgggagggtaagtaggacagggcgtgcctctccaagggcagagggatgtgagaacttgcagtgtggaagggaggcctcaactggagatgcatgagatgttagcttctggatggatttgaaactccagactgggtaagatcattgagggagcgagtgctgatagaaataggaggagaaggcctaaagactcctccaggcactccaacaagacaacaaatggccaggaagaatcaggaaagaagactgaaaggaagcaacagtgaggtggtggaagaccttgaatgccagagtaaggagtttggtggagattgttgaggcactagttcttcagggaaggcctca

SEQ ID NO: 334326 - DNA, 220 bp, Homo sapiens
atgtcctgaaacttccatgctgttgggagctcctagcccccttcaatgcagaccaaatcacccagctcccagacaagggttccaactcacagctgctacatgtgagctcccagatgggatagctctataatgtgccgcacctacatccccatttaaaggaaaccgcctgccctcatcccctgccacaggtacttcccagcagggcagttctgttttatgg

SEQ ID NO: 334327 - DNA, 1045 bp, Homo sapiens
catggtggtgggcgcctgtggtcccagctactcgggagactgaggcagaagaatggcatgaacccgggaggcagggattgcagtgagccgagatcacaccactgcacttcagcctgggtgacagagcgagactccatctcaaaaaataaataaataaataaatccagcctcaggggtcattggcatggttaatttaagtcaagaaatttgcatggaagtatttaaatatagtaagttacatgctcacatacaatttcttactattgctagttcattcattcattcactcatccatcctgtgactctggaacaagcacttcctgggtgcccctgttagacactgcagatagagacggcaagcctagcccttgcccctagcctttgcccttctctggctgtagacagtgtgatgactgtgaggaaaaagaagtgctccaaaggcttcctgagcacagaagagaggcagctcgctctgccctggttataacatccagggtccctgaatcttgaacaaagcaggtgagttagctggtagaacagatgtaaggcaagaagaaggggaggcaaggcaaaggtatttcaggttcttataaagacagagagaaccgtgaaagaactcttgagggaactgcaagcagctcagtagggctggaacatgagatgtgaatggtgagtacgaaggctgaggctgcaggcagaaacaggggccaggataccaccatgctaaggacaggccccaaagccaaggaacaatgttttgtggagactgtcactccagcagcagtggacaggaggctgtgagggagaaggtgggtagagggatcagagcagcacgggcagccacggtggtgactgggggtctaggaggcagcagcagatttattggtatcttgcaagcagaattgatgagatctggaaactgaggacttttggagatgagggagaccgagcagtctcagatggtggctgggagtcagtcatcacaccaagggacacagatggaagaactaatcccgacggactgaaatccaatcaatggaattca

SEQ ID NO: 334328 - DNA, 506 bp, Homo sapiens
ggctgcaggatttaataaaattccacaatacttccagtgttaacaatggtgtatgctgggattaatcccacatgaaataatcacaaaatgataccagttagtatgatgcactgctatcctaccacagccgtgcaaattttaaggacagtcttttttggataaggtcccaccagtagataaactccacaaagtctggccaccagggagggtcaattaccaggactacattgtttctctagttcagatgtgcagaatataagggcagtgtgaagttcagcattacaaaaacagaaagcaatttagtaattagtgaaagtattacatggacaaaacaatagctgggagatttgtttaaaggaataaactaataactttgttcataccaacccatttcaaatatgggaaaataatttttaaacatttaaataaaactagaattaacgaaataccttggatacactggctagacaaaagattcctggtcctgactaacttgagaatttcgg

SEQ ID NO: 334329 - DNA, 343 bp, Homo sapiens
tggctttgacactttgaggacactggtgagatggcctgggccagccaacggtccactaggagactgatgggcactgaagccttccaaagcgactgagctggaaccaggggcagggaatcatttagtccccgggcactgcagagaagcggagttctctcattcacatccctgcaatgtcaacagtgagcaacagtgggcaggccctaggcgatttgggaagagcgggtgtcagaaagcctggggtttggccagccacggtgggtcacacctataattccagcactttgggagcctaaagcaggcaggttacttgagctcaggagttggagacaggcctgggcaa

SEQ ID NO: 334330 - DNA, 399 bp, Homo sapiens
ctctccctttctcagaaactgggtatcaccttgactcctccttcctactcatcggctacatcctcacagtcactgacacctgtcagtcagctgagtctccaaagcacttctcagctctgcccaccactcagcctctccaccatcatcacctgctccacgctgtctccttcccaggcctggatccctgaaacagcccttccctggtctccatgcctcccttcttgcccgctccaatccttctctgccttccacaatgcaaatttttattatattgctctctagattaaacactctctacagtttctcatttactgcttcttaagagcatgcaaattccttaccctcatgcatagggtaaccatacgttcccatttgcctgggatggttgcagcttatgcc

SEQ ID NO: 334331 - DNA, 544 bp, Homo sapiens
tagggtctgattagcagctcctcagatgctcactttataactacttgttagaacgtacatggttttgtgtacttttctccatatgtgatttatttcttttatttccttctccttccctcaccatcccccttgaggcatacaaaacacatacacacagaatttagaaagaagtcctgtgcttcagtttttggtcaacaccaggtcaaacgccttcgaacggttcagtctcacttgctgtttcctcgtcgcttaaaaaaaaaggcagagtggcgccaaaatctggttcttaatcttctggaggcctcatggaccccctggagaatctggtacagttacagacattcctcagaataatgcacatccacacaaaaacttgcatatgatttctggcctaaatatctacccccacccagcccactcctaagcccaagtttaaaattcctggtgtagaaaagaagagacagacttcagagttcggtgctattgagttgaaattccagttccatcacttctaggtggtcatccgtgtccctgggcctccctg

SEQ ID NO: 334332 - DNA, 278 bp, Homo sapiens
agacgcaggtgtgattgtaaacaggtggttcaggcagccctcactgagaagacagcatttaaataaagacctaaaggaaatgagcaagtagcccatgcagagacctggcgggaaagcattctagacagaaggaacagcaagtgccaatattctaaggcaagaacctgagtggaagaatacaggagatgagagaagcaatagggtaccaaatcacgtcaggccttgcaggccattgtaacaattccggcttttaccccctgcaagaaaggaagccactg

SEQ ID NO: 334333 - DNA, 105 bp, Homo sapiens
atgttttttaatagaataaaactcattttatcttgcaattaccatatggaccactttgtaaatctaagaagcatttggggatattactggtcttactttacctat

SEQ ID NO: 334334 - DNA, 520 bp, Homo sapiens
tgctgggattacaggggtgagcagagcactgctctaaaaatgttttttgggcaatgtagagttaattttaaacaatggagtttgaatgcctgtaggaagccatgttcctagtcaccacaggtctctcctcagtctcctttactccccgtattgctgcctcacaggcttagatttttccctgtcctgaaggcatctatgaatccaggtttaaagtcaccatggacaatttggcctcaaaggggagaacgggaagtgagattgccggtggggatcagaatcggccagagccagttgagaccatgtcccagagggagcccctatggtgtggagcaatgaccacaattaaaatgtgtttcagtttccaagctcttagcttgagatatgctaacctagactccttcttccgaataacaataatcttaagattataatttaattggaagaagctaggacaacaacaggtgcacatagatacttagcacaataattgctcataatttggcaggaggagcctgggtta

SEQ ID NO: 334335 - DNA, 93 bp, Homo sapiens
atgaatcagcattatgctgagtgaaagaaactttaaacaaaagattccctttgtatgacactgcatcattccctttatatagcattcaacaac

SEQ ID NO: 334336 - DNA, 387 bp, Homo sapiens
atacttgagcattaggctgtggtccaggaaaaagaaatgtccagtgaaaggctactctaaagacccacaggcccctcccctagagccccattagagtgaggtagagtttatagccattctcctgagagacctcaagacctaattagaagaaaactataacatttgttatatagaaggcattttccaaagactagttcaaagatgaaagatatagtcttcctttggatataaaacaaaatctcaagatacaccaaaactgttttgcttttactgaataatttttgtgcatatgtgtttagctgcaagtgcctaacaagctgtgattttctttcctttcctttccctttttttttgtcttgagacagccttgctctgtcacccaggctg

SEQ ID NO: 334337 - DNA, 473 bp, Homo sapiens
cgcacctgaccagcatttcttttttcttttgagagagggtcttgctctgtcacctaggctgaagtgcagtggtgtcatcatggctcactgcagcctcgacctcctggcctcaagcgatcctcccacctcagcatcccaagtagctgggattacaggtgtgtgctaccacacctggttaatttttatattttttgtagagtcaaggttttgccatgttgcctaggctggtctcaaactcctgagctcaagtgatcgtctcacctggcctcctaaagtgctgggattacaagcatgagccaccacaccctgcccccgaggcggcttttaaccagcatctggggtgaccaatctaagtagacagggtcaggacaacactgatgtgtatacagatgctgtttccctgctgttctcttctaagtatgaatcccggtcccctttgcagacccagtaggtgaatccaattacgtagagca

SEQ ID NO: 334338 - DNA, 117 bp, Homo sapiens
ctaactgggctaaggaatgcctggatagctggaaaaacatgatttctgttttgggtagaactgtgagggtgtccctggaaatgattggcatttgaacagagtaaagatccctcttgc

SEQ ID NO: 334339 - DNA, 131 bp, Homo sapiens
ctgcaaatccttattgtgttagttttaattgatcttggtaattaacgtttttgatatgtgggatttttatcattaatttaaaatgtttcttatttcagaataattcttgagaaagatgaggaacagcctag

SEQ ID NO: 334340 - DNA, 457 bp, Homo sapiens
  misc_feature (27)..(27): n is a, c, g, or t
ctagaggatcccaagaagaactctggngacagtgagcagatctggacaaggacctcagtgtggtacccacttctgacatctggaccacttcttgcagtcattgggggtcatcccccacactggtaacctgtcatcaaatgggccacagcaacattcagcttaagtatttctccttcccacatccaagggattgagtgggagtgagattggggggtggaaaaaacagtgaacagtcctggtgagttgcagatgtggtctcattccctagagatgcaggatgcagctgacctgaatcaggacagatccctgcaggagggactcctggtgccatgtcagtcccacctggcactgccctagctcccaggctccgcctctgcatctttccttgctacttcctctttcacttctcccccgttcccagacccaccagacagagcttccagagtgtcaggacatg

SEQ ID NO: 334341 - DNA, 171 bp, Homo sapiens
ggggggctggggcgtggtccaggtggggagtgataagccctgaacggacagaaaagaagggatggagccaagaaattaggaggtcaaaggggccactgagaggggcaaggaggggagaggagttgagaagggctctgaggtgtaggagtgggcgccttggctagagagggt

SEQ ID NO: 334342 - DNA, 265 bp, Homo sapiens
tctgcgcactctgatttggcctcctcagttaagcctgagcccagatggagttggccccagcccacctgtgcccgactgcgtccgggcctatggggccctgccctcgtgccatttctcttcttgcagaagatatcaggagagagcctaggctcatcttcattccttcttgcccttctccacaaatcacttctgccaagatggaaagcagtggattagatctcaacacacagacagaataaccgcatttcatggtttaagcccttca

SEQ ID NO: 334343 - DNA, 2732 bp, Homo sapiens
cacacttggactcttttcaaacattaggttagtttgtaatgaaagcaaaaaatttgtgaatagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccacctcggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattcggatgcaatgacaaactgacttcccccaaagcagacactactccagtatgtcccagtagaacactcatttgcaatgtgttgagctccgttaagcacacacacactcacacaacaggctcacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccgaa

SEQ ID NO: 334344 - DNA, 6867 bp, Homo sapiens
tggggtggtacagctgccgctggggtctccttacctgccccacacacagggagggagacctgagtggcggatggacatagtttaagggccggtgttgcaaacttatgaaaagaaaagaattttgagtcagtaacatttttgcaggccccataagcagatcgcctccccaccgcccaaatcccgagtcctttccttttcccactggttttaggaagtggcagcctgctcccagggctgcttgttgaggaagctgcctcccacactctttctccttactgcctctgcagggaggataagacagagcagcttgtggacaccagacatgaggtggaccagctggtgctggaactgcagaaagttaagcaggagaacatccagctagcggcagacgcccggtctgctcgtgcctatcgagacgagctggattccctgcgggagaaggcgaaccgcgtggagaggctggagctggagctgacccgctgcaaggagaagctgcacgacgtggacttctacaaggcccgcatggaggagctgagagaagataatatcattttaattgaaaccaaggccatgctggaggaacagctgactgctgctcgggcccggggcgataaagtccatgagctggaaaaggagaacctgcagctgaaatccaagcttcacgacctggaattggaccgggacacagataagaaacgaattgaggagctgctggaagaaaacatggtccttgagattgcacagaagcagagcatgaacgaatctgcccaccttggctgggagctggagcagctgtccaagaacgcagacttgtcagacgcctccaggaagtcgtttgtgtttgagctgaacgaatgtgcgtccagccgcatcctgaagctggagaaggagaatcagagcctccagagcaccatccaggggctgcgggacgcgtccctggtgttggaggagagcggcctcaagtgcggggagctggagaaggagaaccaccagctcagcaagaagattgaaaagttacaaacccagctggagagagaaaagcagagcaaccaagatctggagaccctcagtgaggagctgatcagagagaaggagcagctgcagagtgacatggagaccctgaaggctgacaaagccaggcagatcaaggaccttgagcaggaaaaggaccacctcaaccgagccatgtggtcgctgcgggagaggtcgcaggtcagcagtgaggcccgcatgaaagacgtggagaaggagaacaaagccctccaccagacggtgacggaggccaatggcaagctcagccagttggagtttgagaagcggcagctgcacagggacttggagcaggccaaggagaagggggagcgggcagagaagctggagagggagctacagcgactccaggaggagaacgggaggctggccaggaaggtgacctccctggagacagccaccgagaaagtcgaggccctggagcatgagagccagggcctgcagctggagaaccggactctgaggaagtctctggacaccttgcagaacgtgtccctgcagcttgagggcctggagcgtgacaacaagcagctggacgcagagaacctggagctgcgcaggctggtggagaccatgcgcttcaccagcaccaagctggcacagatggagagggagaaccagcagctggagcgtgagaaggaggagctgaggaagaacgtggatctgctcaaggcgctgggcaagaagtcagagcgcctggagctcagctaccagagcgtgagcgctgagaacctccggctgcagcagagcctggagagcagcagccacaagacgcagaccttggagagtgagctgggcgagctggaggctgagcgccaggcgctgcggcgggacctggaggccctccggctggccaatgcacagttggagggggccgagaaggacaggaaggccctggagcaggaggtggcccagctcgagaaggataagaagctgctggagaaggaggccaagcggctgtggcagcaggtggagctcaaggatgcagtcttggacgatagcactgccaaactgtccgccgttgagaaggagagccgcgcgctggacaaggagctggcccgctgcagggacgcagccggcaagctgaaggagctggagaaggacaaccgggacctcaccaagcaagtcaccgtgcatgcaaggacactgacaactctgagggaggacctggtgctcgagaagctgaagagccagcagctcagcagtgagctggacaagctgagccaggaactggagaaggtcggcctcaacagggagctgctgttgcaggaggacgacagcggcagtgacacaaaatacaagattttggagggcagaaatgaatcagcattaaaaacaacactagccatgaaagaagaaaagattgtgctcttagaagcacagatggaagagaaagcgagcctaaatcgccagttagagagtgagctgcagatgctaaagaaggagtgtgagaccctcaggcagaaccagggagaggggcagcacttgcagaactctttcaagcaccctgcggggaagacagccgccagtcaccaggggaaggaggcctgggggcccggccataaggaagccaccatggagcttctccgagtgaaggaccgggccatcgagctggagcggaataatgcagctctgcaggctgagaagcagctgctaaaggaacagctgcagcacctggagacccagaacgtgaccttcagcagccagatcttgacactgcagaaacagagcgccttcctgcaggagcacaacaccacactgcagacccagaccgccaagctgcaggtggagaactccacgctgagttcccagagcgcagcgctcaccgcgcagtacacgctgctgcagaaccaccacacggccaaggagacggagaacgaaagcctgcagaggcagcaggagcaacttacagcggcctacgaggccctgctgcaggaccacgagcacctgggcacgctgcacgagcggcaatcggccgagtacgaggccctcatccgccagcacagctgcctaaagacactgcatcggaatctggagctggagcacaaggagctcggggagaggcacggtgacatgctgaagcgcaaggcggagctggaggagcgggagaaggtcttgaccactgagcgagaggcgctgcagcaggagcagaggacaaacgccctcgccatgggcgagaaccagaggctgcggggcgagctggacagggtcaatttcctgcaccaccagctgaagggggagtacgaggagctgcacgcccacaccaaggagctgaaaacctcactgaacaacgcgcagctggagctcaaccgctggcaggcccgcttcgacgagctgaaggagcagcaccagaccatggacatctcgctgaccaagctggacaaccactgtgagctgctctcccgtctcaaggggaacttggaggaagaaaatcatcacctcctgagccagatccagctgttgagccagcagaaccagatgcttctggagcagaacatggagaacaaggagcagtaccatgaggagcagaagcagtacatagacaaattaaatgccttacgaagacataaggaaaagctggaagaaaaaatcatggatcaatacaagttctatgatcctcctccaaagaagaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgggtctgtggggaaaggccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccacctcggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattcggatgcaatgacaaactgacttcccccaaagcagacactactccagtatgtcccagtagaacactcatttgcaatgtgttgagctccgttaagcacacacacactcacacaacaggctcacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccgaa

SEQ ID NO: 334345 - DNA, 5945 bp, Homo sapiens
ggggtggtttctgttttgttttaaatcatggttcacttcgtaggactgatgtctgcactgggctgggtcttttggttctgcagattgaaaagttacaaacccagctggagagagaaaagcagagcaaccaagatctggagaccctcagtgaggagctgatcagagagaaggagcagctgcagagtgacatggagaccctgaaggctgacaaagccaggcagatcaaggaccttgagcaggaaaaggaccacctcaaccgagccatgtggtcgctgcgggagaggtcgcaggtcagcagtgaggcccgcatgaaagacgtggagaaggagaacaaagccctccaccagacggtgacggaggccaatggcaagctcagccagttggagtttgagaagcggcagctgcacagggacttggagcaggccaaggagaagggggagcgggcagagaagctggagagggagctacagcgactccaggaggagaacgggaggctggccaggaaggtgacctccctggagacagccaccgagaaagtcgaggccctggagcatgagagccagggcctgcagctggagaaccggactctgaggaagtctctggacaccttgcagaacgtgtccctgcagcttgagggcctggagcgtgacaacaagcagctggacgcagagaacctggagctgcgcaggctggtggagaccatgcgcttcaccagcaccaagctggcacagatggagagggagaaccagcagctggagcgtgagaaggaggagctgaggaagaacgtggatctgctcaaggcgctgggcaagaagtcagagcgcctggagctcagctaccagagcgtgagcgctgagaacctccggctgcagcagagcctggagagcagcagccacaagacgcagaccttggagagtgagctgggcgagctggaggctgagcgccaggcgctgcggcgggacctggaggccctccggctggccaatgcacagttggagggggccgagaaggacaggaaggccctggagcaggaggtggcccagctcgagaaggataagaagctgctggagaaggaggccaagcggctgtggcagcaggtggagctcaaggatgcagtcttggacgatagcactgccaaactgtccgccgttgagaaggagagccgcgcgctggacaaggagctggcccgctgcagggacgcagccggcaagctgaaggagctggagaaggacaaccgggacctcaccaagcaagtcaccgtgcatgcaaggacactgacaactctgagggaggacctggtgctcgagaagctgaagagccagcagctcagcagtgagctggacaagctgagccaggaactggagaaggtcggcctcaacagggagctgctgttgcaggaggacgacagcggcagtgacacaaaatacaagattttggagggcagaaatgaatcagcattaaaaacaacactagccatgaaagaagaaaagattgtgctcttagaagcacagatggaagagaaagcgagcctaaatcgccagttagagagtgagctgcagatgctaaagaaggagtgtgagaccctcaggcagaaccagggagaggggcagcacttgcagaactctttcaagcaccctgcggggaagacagccgccagtcaccaggggaaggaggcctgggggcccggccataaggaagccaccatggagcttctccgagtgaaggaccgggccatcgagctggagcggaataatgcagctctgcaggctgagaagcagctgctaaaggaacagctgcagcacctggagacccagaacgtgaccttcagcagccagatcttgacactgcagaaacagagcgccttcctgcaggagcacaacaccacactgcagacccagaccgccaagctgcaggtggagaactccacgctgagttcccagagcgcagcgctcaccgcgcagtacacgctgctgcagaaccaccacacggccaaggagacggagaacgaaagcctgcagaggcagcaggagcaacttacagcggcctacgaggccctgctgcaggaccacgagcacctgggcacgctgcacgagcggcaatcggccgagtacgaggccctcatccgccagcacagctgcctaaagacactgcatcggaatctggagctggagcacaaggagctcggggagaggcacggtgacatgctgaagcgcaaggcggagctggaggagcgggagaaggtcttgaccactgagcgagaggcgctgcagcaggagcagaggacaaacgccctcgccatgggcgagaaccagaggctgcggggcgagctggacagggtcaatttcctgcaccaccagctgaagggggagtacgaggagctgcacgcccacaccaaggagctgaaaacctcactgaacaacgcgcagctggagctcaaccgctggcaggcccgcttcgacgagctgaaggagcagcaccagaccatggacatctcgctgaccaagctggacaaccactgtgagctgctctcccgtctcaaggggaacttggaggaagaaaatcatcacctcctgagccagatccagctgttgagccagcagaaccagatgcttctggagcagaacatggagaacaaggagcagtaccatgaggagcagaagcagtacatagacaaattaaatgccttacgaagacataaggaaaagctggaagaaaaaatcatggatcaatacaagttctatgatcctcctccaaagaagaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgggtctgtggggaaaggccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccacctcggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattcggatgcaatgacaaactgacttcccccaaagcagacactactccagtatgtcccagtagaacactcatttgcaatgtgttgagctccgttaagcacacacacactcacacaacaggctcacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccgaa

SEQ ID NO: 334346 - DNA, 5507 bp, Homo sapiens
catacctggaccttctggcatacctggactttggcatacctggacttctggcatacctgaccttctggcatacctggaccttctcggcgccctccggctggccaatgcacagttggagggggccgagaaggacaggaaggccctggagcaggaggtggcccagctcgagaaggataagaagctgctggagaaggaggccaagcggctgtggcagcaggtggagctcaaggatgcagtcttggacgatagcactgccaaactgtccgccgttgagaaggagagccgcgcgctggacaaggagctggcccgctgcagggacgcagccggcaagctgaaggagctggagaaggacaaccgggacctcaccaagcaagtcaccgtgcatgcaaggacactgacaactctgagggaggacctggtgctcgagaagctgaagagccagcagctcagcagtgagctggacaagctgagccaggaactggagaaggtcggcctcaacagggagctgctgttgcaggaggacgacagcggcagtgacacaaaatacaagattttggagggcagaaatgaatcagcattaaaaacaacactagccatgaaagaagaaaagattgtgctcttagaagcacagatggaagagaaagcgagcctaaatcgccagttagagagtgagctgcagatgctaaagaaggagtgtgagaccctcaggcagaaccagggagaggggcagcacttgcagaactctttcaagcaccctgcggggaagacagccgccagtcaccaggggaaggaggcctgggggcccggccataaggaagccaccatggagcttctccgagtgaaggaccgggccatcgagctggagcggaataatgcagctctgcaggctgagaagcagctgctaaaggaacagctgcagcacctggagacccagaacgtgaccttcagcagccagatcttgacactgcagaaacagagcgccttcctgcaggagcacaacaccacactgcagacccagaccgccaagctgcaggtggagaactccacgctgagttcccagagcgcagcgctcaccgcgcagtacacgctgctgcagaaccaccacacggccaaggagacggagaacgaaagcctgcagaggcagcaggagcaacttacagcggcctacgaggccctgctgcaggaccacgagcacctgggcacgctgcacgagcggcaatcggccgagtacgaggccctcatccgccagcacagctgcctaaagacactgcatcggaatctggagctggagcacaaggagctcggggagaggcacggtgacatgctgaagcgcaaggcggagctggaggagcgggagaaggtcttgaccactgagcgagaggcgctgcagcaggagcagaggacaaacgccctcgccatgggcgagaaccagaggctgcggggcgagctggacagggtcaatttcctgcaccaccagctgaagggggagtacgaggagctgcacgcccacaccaaggagctgaaaacctcactgaacaacgcgcagctggagctcaaccgctggcaggcccgcttcgacgagctgaaggagcagcaccagaccatggacatctcgctgaccaagctggacaaccactgtgagctgctctcccgtctcaaggggaacttggaggaagaaaatcatcacctcctgagccagatccagctgttgagccagcagaaccagatgcttctggagcagaacatggagaacaaggagcagtaccatgaggagcagaagcagtacatagacaaattaaatgccttacgaagacataaggaaaagctggaagaaaaaatcatggatcaatacaagttctatgatcctcctccaaagaagaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgggtctgtggggaaagcacctccgcgcaaaaagagtccctttttgaaaagcaaaaacaaggacaaagacaagtctccaacgacccacccagctctctctaaacgcctgcggttctggtcttcctccgacatcccatcctctcctaacgagcctctctctttctccgacattggagatttctaatccctttcctttatcatgtgtctgtattgtgtaccctccttcatttccgaaattcaaacaaacaaaaaaagccagcgtctaaaaggccagatggccgatagcggacccctcctcctgcccccaatttcaagcttaaagtagccagcgtggattctgatttcaaaatagaagatgagttgtcacactccctggaccatttcttcagcacaacacagttttagggggagcctcaggatatacgtgcacatgtccttgggccaggatgtccgtactaagccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccacctcggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattcggatgcaatgacaaactgacttcccccaaagcagacactactccagtatgtcccagtagaacactcatttgcaatgtgttgagctccgttaagcacacacacactcacacaacaggctcacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccgaa

SEQ ID NO: 334347 - DNA, 1806 bp, Homo sapiens
caagtcctccagcgccgactccactcccagccccaccagcagcctctctagcgaagacaagcagcacctggccgtagagctggccgacaccaaggccaggctgcggcgcgtcaggcaggagctggaggataagacagagcagcttgtggacaccagacatgaggtggaccagctggtgctggaactgcagaaagttaagcaggagaacatccagctagcggcagacgcccggtctgctcgtgcctatcgagacgagctggattccctgcgggagaaggcgaaccgcgtggagaggctggagctggagctgacccgctgcaaggagaagctgcacgacgtggacttctacaaggcccgcatggaggagctgagagaagataatatcattttaattgaaaccaaggccatgctggaggaacagctgactgctgctcgggcccggggcgataaagtccatgagctggaaaaggagaacctgcagctgaaatccaagcttcacgacctggaattggaccgggacacagataagaaacgaattgaggagctgctggaagaaaacatggtccttgagattgcacagaagcagagcatgaacgaatctgcccaccttggctgggagctggagcagctgtccaagaacgcagacttgtcagacgcctccaggaagtcgtttgtgtttgagctgaacgaatgtgcgtccagccgcatcctgaagctggagaaggagaatcagagcctccagagcaccatccaggggctgcgggacgcgtccctggtgttggaggagagcggcctcaagtgcggggagctggagaaggagaaccaccagctcagcaagaagattgaaaagttacaaacccagctggagagagaaaagcagagcaaccaagatctggagaccctcagtgaggagctgatcagagagaaggagcagctgcagagtgacatggagaccctgaaggctgacaaagccaggcagatcaaggaccttgagcaggaaaaggaccacctcaaccgagccatgtggtcgctgcgggagaggtcgcaggtcagcagtgaggcccgcatgaaagacgtggagaaggagaacaaagccctccaccagacggtgacggaggccaatggcaagctcagccagttggagtttgagaagcggcagctgcacagggacttggagcaggccaaggagaagggggagcgggcagagaagctggagagggagctacagcgactccaggaggagaacgggaggctggccaggaaggtgacctccctggagacagccaccgagaaagtcgaggccctggagcatgagagccagggcctgcagctggagaaccggactctgaggaagtctctggacaccttgcagaacgtgtccctgcagcttgagggcctggagcgtgacaacaagcagctggacgcagagaacctggagctgcgcaggctggtggagaccatgcgcttcaccagcaccaagctggcacagatggagagggagaaccagcagctcgcccctgagttaactcacgagcgagctgccatcacacgaaatggtaacccgagaatacaccatcaacattcacaagcgcatccatggagtgggcttcaagaagcgtgcacctcgggcactcaaagagattcgcgacattcgccaatgaaggagatgcggaacatccagatgtgcccatgacacccaggctaaacaaagcggtctgatcccaaggaatacaggaatgtcccataccgaagccgtgcccagtcacgccgcgtagaagcccactccaggagcgctgtgcatgtgag

SEQ ID NO: 334348 - DNA, 319 bp, Homo sapiens
tcccaggggcttcagtaaatctcagggtcatagagctccctgaacccacggcgcatgccaccattcccgtattccaaactcagtgaccatgacggtggtgagcaccctcatctcaatcctggaaaaataccagccccgggtacaccaggttccaggctgggccgatgagtaaattcacttgtttgatttaaaactggattgataggttttctttctcctatattcacagagacaaattaaatgccttacgaagacataaggaaaagctggaagaaaaaatcatggatcaatacaagttctatgatcctcctccaaagaa

SEQ ID NO: 334349 - DNA, 326 bp, Homo sapiens
gtcatgagcgtcattgtcctgaaccccacgtgagtggcctagcttcccagactggggaagaacatcccagcccatgttagggaaccagggacccactgggggtgtgtgggagggctggctatgtcctaaacatctacttctaaccaggaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacaccc

SEQ ID NO: 334350 - DNA, 6703 bp, Homo sapiens
caagtcctccagcgccgactccactcccagccccaccagcagcctctctagcgaagacaagcagcacctggccgtagagctggccgacaccaaggccaggctgcggcgcgtcaggcaggagctggaggataagacagagcagcttgtggacaccagacatgaggtggaccagctggtgctggaactgcagaaagttaagcaggagaacatccagctagcggcagacgcccggtctgctcgtgcctatcgagacgagctggattccctgcgggagaaggcgaaccgcgtggagaggctggagctggagctgacccgctgcaaggagaagctgcacgacgtggacttctacaaggcccgcatggaggagctgagagaagataatatcattttaattgaaaccaaggccatgctggaggaacagctgactgctgctcgggcccggggcgataaagtccatgagctggaaaaggagaacctgcagctgaaatccaagcttcacgacctggaattggaccgggacacagataagaaacgaattgaggagctgctggaagaaaacatggtccttgagattgcacagaagcagagcatgaacgaatctgcccaccttggctgggagctggagcagctgtccaagaacgcagacttgtcagacgcctccaggaagtcgtttgtgtttgagctgaacgaatgtgcgtccagccgcatcctgaagctggagaaggagaatcagagcctccagagcaccatccaggggctgcgggacgcgtccctggtgttggaggagagcggcctcaagtgcggggagctggagaaggagaaccaccagctcagcaagaagattgaaaagttacaaacccagctggagagagaaaagcagagcaaccaagatctggagaccctcagtgaggagctgatcagagagaaggagcagctgcagagtgacatggagaccctgaaggctgacaaagccaggcagatcaaggaccttgagcaggaaaaggaccacctcaaccgagccatgtggtcgctgcgggagaggtcgcaggtcagcagtgaggcccgcatgaaagacgtggagaaggagaacaaagccctccaccagacggtgacggaggccaatggcaagctcagccagttggagtttgagaagcggcagctgcacagggacttggagcaggccaaggagaagggggagcgggcagagaagctggagagggagctacagcgactccaggaggagaacgggaggctggccaggaaggtgacctccctggagacagccaccgagaaagtcgaggccctggagcatgagagccagggcctgcagctggagaaccggactctgaggaagtctctggacaccttgcagaacgtgtccctgcagcttgagggcctggagcgtgacaacaagcagctggacgcagagaacctggagctgcgcaggctggtggagaccatgcgcttcaccagcaccaagctggcacagatggagagggagaaccagcagctggagcgtgagaaggaggagctgaggaagaacgtggatctgctcaaggcgctgggcaagaagtcagagcgcctggagctcagctaccagagcgtgagcgctgagaacctccggctgcagcagagcctggagagcagcagccacaagacgcagaccttggagagtgagctgggcgagctggaggctgagcgccaggcgctgcggcgggacctggaggccctccggctggccaatgcacagttggagggggccgagaaggacaggaaggccctggagcaggaggtggcccagctcgagaaggataagaagctgctggagaaggaggccaagcggctgtggcagcaggtggagctcaaggatgcagtcttggacgatagcactgccaaactgtccgccgttgagaaggagagccgcgcgctggacaaggagctggcccgctgcagggacgcagccggcaagctgaaggagctggagaaggacaaccgggacctcaccaagcaagtcaccgtgcatgcaaggacactgacaactctgagggaggacctggtgctcgagaagctgaagagccagcagctcagcagtgagctggacaagctgagccaggaactggagaaggtcggcctcaacagggagctgctgttgcaggaggacgacagcggcagtgacacaaaatacaagattttggagggcagaaatgaatcagcattaaaaacaacactagccatgaaagaagaaaagattgtgctcttagaagcacagatggaagagaaagcgagcctaaatcgccagttagagagtgagctgcagatgctaaagaaggagtgtgagaccctcaggcagaaccagggagaggggcagcacttgcagaactctttcaagcaccctgcggggaagacagccgccagtcaccaggggaaggaggcctgggggcccggccataaggaagccaccatggagcttctccgagtgaaggaccgggccatcgagctggagcggaataatgcagctctgcaggctgagaagcagctgctaaaggaacagctgcagcacctggagacccagaacgtgaccttcagcagccagatcttgacactgcagaaacagagcgccttcctgcaggagcacaacaccacactgcagacccagaccgccaagctgcaggtggagaactccacgctgagttcccagagcgcagcgctcaccgcgcagtacacgctgctgcagaaccaccacacggccaaggagacggagaacgaaagcctgcagaggcagcaggagcaacttacagcggcctacgaggccctgctgcaggaccacgagcacctgggcacgctgcacgagcggcaatcggccgagtacgaggccctcatccgccagcacagctgcctaaagacactgcatcggaatctggagctggagcacaaggagctcggggagaggcacggtgacatgctgaagcgcaaggcggagctggaggagcgggagaaggtcttgaccactgagcgagaggcgctgcagcaggagcagaggacaaacgccctcgccatgggcgagaaccagaggctgcggggcgagctggacagggtcaatttcctgcaccaccagctgaagggggagtacgaggagctgcacgcccacaccaaggagctgaaaacctcactgaacaacgcgcagctggagctcaaccgctggcaggcccgcttcgacgagctgaaggagcagcaccagaccatggacatctcgctgaccaagctggacaaccactgtgagctgctctcccgtctcaaggggaacttggaggaagaaaatcatcacctcctgagccagatccagctgttgagccagcagaaccagatgcttctggagcagaacatggagaacaaggagcagtaccatgaggagcagaagcagtacatagacaaattaaatgccttacgaagacataaggaaaagctggaagaaaaaatcatggatcaatacaagttctatgatcctcctccaaagaagaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgggtctgtggggaaaggccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccacctcggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattcggatgcaatgacaaactgacttcccccaaagcagacactactccagtatgtcccagtagaacactcatttgcaatgtgttgagctccgttaagcacacacacactcacacaacaggctcacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccgaa

SEQ ID NO: 334351 - DNA, 7145 bp, Homo sapiens
caagtcctccagcgccgactccactcccagccccaccagcagcctctctagcgaagacaagcagcacctggccgtagagctggccgacaccaaggccaggctgcggcgcgtcaggcaggagctggaggataagacagagcagcttgtggacaccagacatgaggtggaccagctggtgctggaactgcagaaagttaagcaggagaacatccagctagcggcagacgcccggtctgctcgtgcctatcgagacgagctggattccctgcgggagaaggcgaaccgcgtggagaggctggagctggagctgacccgctgcaaggagaagctgcacgacgtggacttctacaaggcccgcatggaggagctgagagaagataatatcattttaattgaaaccaaggccatgctggaggaacagctgactgctgctcgggcccggggcgataaagtccatgagctggaaaaggagaacctgcagctgaaatccaagcttcacgacctggaattggaccgggacacagataagaaacgaattgaggagctgctggaagaaaacatggtccttgagattgcacagaagcagagcatgaacgaatctgcccaccttggctgggagctggagcagctgtccaagaacgcagacttgtcagacgcctccaggaagtcgtttgtgtttgagctgaacgaatgtgcgtccagccgcatcctgaagctggagaaggagaatcagagcctccagagcaccatccaggggctgcgggacgcgtccctggtgttggaggagagcggcctcaagtgcggggagctggagaaggagaaccaccagctcagcaagaagattgaaaagttacaaacccagctggagagagaaaagcagagcaaccaagatctggagaccctcagtgaggagctgatcagagagaaggagcagctgcagagtgacatggagaccctgaaggctgacaaagccaggcagatcaaggaccttgagcaggaaaaggaccacctcaaccgagccatgtggtcgctgcgggagaggtcgcaggtcagcagtgaggcccgcatgaaagacgtggagaaggagaacaaagccctccaccagacggtgacggaggccaatggcaagctcagccagttggagtttgagaagcggcagctgcacagggacttggagcaggccaaggagaagggggagcgggcagagaagctggagagggagctacagcgactccaggaggagaacgggaggctggccaggaaggtgacctccctggagacagccaccgagaaagtcgaggccctggagcatgagagccagggcctgcagctggagaaccggactctgaggaagtctctggacaccttgcagaacgtgtccctgcagcttgagggcctggagcgtgacaacaagcagctggacgcagagaacctggagctgcgcaggctggtggagaccatgcgcttcaccagcaccaagctggcacagatggagagggagaaccagcagctggagcgtgagaaggaggagctgaggaagaacgtggatctgctcaaggcgctgggcaagaagtcagagcgcctggagctcagctaccagagcgtgagcgctgagaacctccggctgcagcagagcctggagagcagcagccacaagacgcagaccttggagagtgagctgggcgagctggaggctgagcgccaggcgctgcggcgggacctggaggccctccggctggccaatgcacagttggagggggccgagaaggacaggaaggccctggagcaggaggtggcccagctcgagaaggataagaagctgctggagaaggaggccaagcggctgtggcagcaggtggagctcaaggatgcagtcttggacgatagcactgccaaactgtccgccgttgagaaggagagccgcgcgctggacaaggagctggcccgctgcagggacgcagccggcaagctgaaggagctggagaaggacaaccgggacctcaccaagcaagtcaccgtgcatgcaaggacactgacaactctgagggaggacctggtgctcgagaagctgaagagccagcagctcagcagtgagctggacaagctgagccaggaactggagaaggtcggcctcaacagggagctgctgttgcaggaggacgacagcggcagtgacacaaaatacaagattttggagggcagaaatgaatcagcattaaaaacaacactagccatgaaagaagaaaagattgtgctcttagaagcacagatggaagagaaagcgagcctaaatcgccagttagagagtgagctgcagatgctaaagaaggagtgtgagaccctcaggcagaaccagggagaggggcagcacttgcagaactctttcaagcaccctgcggggaagacagccgccagtcaccaggggaaggaggcctgggggcccggccataaggaagccaccatggagcttctccgagtgaaggaccgggccatcgagctggagcggaataatgcagctctgcaggctgagaagcagctgctaaaggaacagctgcagcacctggagacccagaacgtgaccttcagcagccagatcttgacactgcagaaacagagcgccttcctgcaggagcacaacaccacactgcagacccagaccgccaagctgcaggtggagaactccacgctgagttcccagagcgcagcgctcaccgcgcagtacacgctgctgcagaaccaccacacggccaaggagacggagaacgaaagcctgcagaggcagcaggagcaacttacagcggcctacgaggccctgctgcaggaccacgagcacctgggcacgctgcacgagcggcaatcggccgagtacgaggccctcatccgccagcacagctgcctaaagacactgcatcggaatctggagctggagcacaaggagctcggggagaggcacggtgacatgctgaagcgcaaggcggagctggaggagcgggagaaggtcttgaccactgagcgagaggcgctgcagcaggagcagaggacaaacgccctcgccatgggcgagaaccagaggctgcggggcgagctggacagggtcaatttcctgcaccaccagctgaagggggagtacgaggagctgcacgcccacaccaaggagctgaaaacctcactgaacaacgcgcagctggagctcaaccgctggcaggcccgcttcgacgagctgaaggagcagcaccagaccatggacatctcgctgaccaagctggacaaccactgtgagctgctctcccgtctcaaggggaacttggaggaagaaaatcatcacctcctgagccagatccagctgttgagccagcagaaccagatgcttctggagcagaacatggagaacaaggagcagtaccatgaggagcagaagcagtacatagacaaattaaatgccttacgaagacataaggaaaagctggaagaaaaaatcatggatcaatacaagttctatgatcctcctccaaagaagaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgggtctgtggggaaagcacctccgcgcaaaaagagtccctttttgaaaagcaaaaacaaggacaaagacaagtctccaacgacccacccagctctctctaaacgcctgcggttctggtcttcctccgacatcccatcctctcctaacgagcctctctctttctccgacattggagatttctaatccctttcctttatcatgtgtctgtattgtgtaccctccttcatttccgaaattcaaacaaacaaaaaaagccagcgtctaaaaggccagatggccgatagcggacccctcctcctgcccccaatttcaagcttaaagtagccagcgtggattctgatttcaaaatagaagatgagttgtcacactccctggaccatttcttcagcacaacacagttttagggggagcctcaggatatacgtgcacatgtccttgggccaggatgtccgtactaagccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccacctcggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattcggatgcaatgacaaactgacttcccccaaagcagacactactccagtatgtcccagtagaacactcatttgcaatgtgttgagctccgttaagcacacacacactcacacaacaggctcacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccgaa

SEQ ID NO: 334352 - DNA, 3362 bp, Homo sapiens
tgttgtggccaggtgggcaggtgccctcagcaccataaaccttgatttttttcctttggggcagatgtaaatttgaggcaaatgacacaaagaagctgaagaatagcaaatgtccaggagaagggagtgcccccttccttcccaggcccctggcacctgctccctgtgggtcccctgacgtgacaccttcaggtgcgtgcccttacatgtgcgcacacatggccctgaacggtcctcatctctcttcccgtggcctcggcctcggctgtccacatgtgttccagaaagctctgtgcagtaatagaggagggccccccgcaacctcaacctctggttcacccagcacagccttttttttgtctgccctctatactggcgttctgtgtgagatttcctttgtgaagttgtttgaagctgcagccccaggcctcataaatgtagataagcagagtatcatctgttgatggctgcttgtgctgtgcccagcactccgttggtgaagtgaggcttcctcactggagcgcagagggagtcccagagctcctccttcctgagggcgttgggcttagctttggcatgggattgttttgctgcatcgtttttcttagatggctcatctgggatatacctggtcattggctttttaattttaacactgccatttcctttcagtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccacctcggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattcggatgcaatgacaaactgacttcccccaaagcagacactactccagtatgtcccagtagaacactcatttgcaatgtgttgagctccgttaagcacacacacactcacacaacaggctcacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccgaa

SEQ ID NO: 334353 - DNA, 1008 bp, Homo sapiens
caagtcctccagcgccgactccactcccagccccaccagcagcctctctagcgaagacaagcagcacctggccgtagagctggccgacaccaaggccaggctgcggcgcgtcaggcaggagctggaggataagacagagcagcttgtggacaccagacatgaggtggaccagctggtgctggaactgcagaaagttaagcaggagaacatccagctagcggcagacgcccggtctgctcgtgcctatcgagacgagctggattccctgcgggagaaggcgaaccgcgtggagaggctggagctggagctgacccgctgcaaggagaagctgcacgacgtggacttctacaaggcccgcatggaggagctgagagaagataatatcattttaattgaaaccaaggccatgctggaggaacagctgactgctgctcgggcccggggcgataaagtccatgagctggaaaaggagaacctgcagctgaaatccaagcttcacgacctggaattggaccgggacacagataagaaacgaattgaggagctgctggaagaaaacatggtccttgagattgcacagaagcagagcatgaacgaatctgcccaccttggctgggagctggagcagctgtccaagaacgcagacttgtcagacgcctccaggaagtcgtttgtgtttgagctgaacgaatgtgcgtccagccgcatcctgaagctggagaaggagaatcagagcctccagagcaccatccaggggctgcgggacgcgtccctggtgttggaggagagcggcctcaagtgcggggagctggagaaggagaaccaccagctcagcaagaagattgaaaagttacaaacccagctggagagagaaaagcagagcaaccaagatctggagaccctcagtgaggagctgatcagagagaaggagcagctgcagagtgacatggagaccctgaaggctgacaaagccaggcaggtaggtgcctccaccactaacgcctctcc

SEQ ID NO: 334354 - DNA, 181 bp, Homo sapiens
gggttcctgctctatcacctacaccaccaccaccacgtgcaggcccgagaaggcaaaagaggcccagccactctcaccggggattttatccgcctccccggcacacacacactctcactcacgcactcgctcgccggccttccagctgtctgtgtccggggcggggaccggcttggcgcag

SEQ ID NO: 334355 - DNA, 1687 bp, Homo sapiens
ggcggctccggtcggagacaatcgcgctgagcgggcgccgcagcgggagcgggagccggagctgcgaggcgcggcgcagagctggggctgcgcggggccgggcgagcgggaccaggcgggagccatggaccgctagggcccggcctagccccgcgatgccgccggcgagtggccccagcgtcctcgcgcggctgttgccgctgctggggctgctgctcggcagcgcctcccgggctcccggcaagtcgccgccggagccccccagcccgcaggagatcctgatcaaggtgcaggtgtatgtgagcggggagctggtgcccctggcccgggcctcagtggatgtgtttgggaaccggactctgctggcagctggcaccacagactcagagggtgtggccaccctgcccctcagttatcgcttgggcacctgggtgctggtcactgctgcccgccctggcttcctcaccaactctgtgccctggcgtgttgacaagctgcccttgtatgcgtctgtcagcctctacctgctccctgagcggccggccacgctcatcctctatgaggacctggtgcacattctcctaggctctcccggtgcccgctcccagcccttggtgcagttccagcgccgggctgcccgcctgcctgtcagctccacctacagccagctctgggcgtcacttacgcctgccagcacccagcaggaaatgcgggctttccctgccttcctgggcactgaggcctccagctcaggcaatggctcctggctggagctgatgcccctgactgctgtgagcgtgcacctgctgacaggtaatgggacagaggtgccgctctcaggccccattcacctgtccctgcccgtgccctccgagactcgtgccctcaccgtgggcaccagcattccagcctggagatttgaccccaagagtgggctgtgggtgcgcaatggcactggtgtaatccggaaggaaggccggcagctctactggaccttcgtctccccccagctggggtactgggtggccgccatggcctcccccacggctgggctggtcaccatcacgtcgggcatccaggacatcggcacctaccacaccatcttcttgctcaccatcctggcagccctggccctgctggtgcttatcctgctgtgtctgctcatctactactgccggaggcgctgcctgaagccgaggcaacagcaccgcaagctgcagctctcggggccctctgacggtaacaaacgagaccaggccacctcgatgtcccagctccacctcatctgtgggggacccctggaacccgccccgtcgggggaccccgaggctccgcctccaggccccctccactcggccttctccagctcccgggacttggcctcctcccgggatgacttcttccgcaccaagccgcgctctgccagccgcccggccgccgagccttcgggtgcccgcgggggcgagagcgccgggctcaagggcgctcgctcggccgagggccccggcgggctggagcccggcctagaggagcaccggcgggggccctcgggggctgcggccttcctgcacgagccgccctcgccgccgccgcccttcgaccactacctgggccacaagggggcggccgagggcaagacccccgacttcctgctgtcgcagtcggtggaccagctggcgcggccgct

SEQ ID NO: 334356 - DNA, 1769 bp, Homo sapiens
ggcggctccggtcggagacaatcgcgctgagcgggcgccgcagcgggagcgggagccggagctgcgaggcgcggcgcagagctggggctgcgcggggccgggcgagcgggaccaggcgggagccatggaccgctagggcccggcctagccccgcgatgccgccggcgagtggccccagcgtcctcgcgcggctgttgccgctgctggggctgctgctcggcagcgcctcccgggctcccggcaagtcgccgccggagccccccagcccgcaggagatcctgatcaaggtgcaggtgtatgtgagcggggagctggtgcccctggcccgggcctcagtggatgtgtttgggaaccggactctgctggcagctggcaccacagactcagagggtgtggccaccctgcccctcagttatcgcttgggcacctgggtgctggtcactgctgcccgccctggcttcctcaccaactctgtgccctggcgtgttgacaagctgcccttgtatgcgtctgtcagcctctacctgctccctgagcggccggccacgctcatcctctatgaggacctggtgcacattctcctaggctctcccggctgtgccaggcattgtggctggtgctgggaaccacggtgaggaagaagacccgctctttgcctttggacgttcacagacaagtgcccgctcccagcccttggtgcagttccagcgccgggctgcccgcctgcctgtcagctccacctacagccagctctgggcgtcacttacgcctgccagcacccagcaggaaatgcgggctttccctgccttcctgggcactgaggcctccagctcaggcaatggctcctggctggagctgatgcccctgactgctgtgagcgtgcacctgctgacaggtaatgggacagaggtgccgctctcaggccccattcacctgtccctgcccgtgccctccgagactcgtgccctcaccgtgggcaccagcattccagcctggagatttgaccccaagagtgggctgtgggtgcgcaatggcactggtgtaatccggaaggaaggccggcagctctactggaccttcgtctccccccagctggggtactgggtggccgccatggcctcccccacggctgggctggtcaccatcacgtcgggcatccaggacatcggcacctaccacaccatcttcttgctcaccatcctggcagccctggccctgctggtgcttatcctgctgtgtctgctcatctactactgccggaggcgctgcctgaagccgaggcaacagcaccgcaagctgcagctctcggggccctctgacggtaacaaacgagaccaggccacctcgatgtcccagctccacctcatctgtgggggacccctggaacccgccccgtcgggggaccccgaggctccgcctccaggccccctccactcggccttctccagctcccgggacttggcctcctcccgggatgacttcttccgcaccaagccgcgctctgccagccgcccggccgccgagccttcgggtgcccgcgggggcgagagcgccgggctcaagggcgctcgctcggccgagggccccggcgggctggagcccggcctagaggagcaccggcgggggccctcgggggctgcggccttcctgcacgagccgccctcgccgccgccgcccttcgaccactacctgggccacaagggggcggccgagggcaagacccccgacttcctgctgtcgcagtcggtggaccagctggcgcggccgct

SEQ ID NO: 334357 - DNA, 597 bp, Homo sapiens
gggaacaaattctatttctgttttctaacgtaacaggattagtggaggcgcatcaaaaattccattctaagtcagtgctgcgtcttgaagagaattgaaatggtctagtactaactttttaacattgactttgaatacacttttaataatccacatgtcagtcagcttactcttggtgttaaatgtcactcgagcaggaggaggcctcgatgggagcttctttttaatctccaatggatcctcagtgaagtccttagggatttcattttctgggtttcagaagtacacacacctgtcattagggcttcatatgcctagcgtgtgaccccctgccctacccttaagcctaaggcagtcatatggtttttaatgtgtctatcctgccttgaaaccaaacctctccaagaactaaaacaaaaatgtgaattactccttgcccttcaggctgcttcgttggaaagccttccctcacttgagccccttgctgagagccctgtagcaccctgtgaagtggccccgttttccttcctgtctatgcaggcagggacctggctgtgggtggtgccccgtgggcagaacccagaggctggggggctc

SEQ ID NO: 334358 - DNA, 821 bp, Homo sapiens
  misc_feature (791)..(791): n is a, c, g, or t
gcactaccgggaaggcgccgtccccaccacccctcctcactgaccggcaagtgaatgagaaggtggagaacctctccattcagctgcggctgatgacccgggagagaaacgagctccgcaagcgcctggcctttgctacgcatggcacggcctttgacaagaggccctaccacaggctgaatcctgactatgagaggctgaagatccagtgcgtgcgagccatgtcggacctgcagagcctgcagaaccagcacaccaacgccttgaagaggtgtgaggaggtggccaaggagactgacttctaccacacactccacagccggctcctgagtgaccagactcggctgaaggatgacgtggacatgctgaggcgggagaatgggcagctgctgcgggagcgaaacctgctgcagcagtcatgggaggacatgaagcggctccacgaggaggaccagaaggagatcggtgacctccgtgcccagcagcagcaggtgttgaagcacaacgggtcatccgagattctcaacaaactgtatgacacggccatggacaagttggaggtggtcaagaaggactatgacgcccttcggaagaggtacagtgagaaagtcgccatccacaatgcagacctgagccgcctggagcagctgggggaggagaaccagcggttgctgaagcagacagagatgctgacccagcagagggacacggccatccagctgcagcaccagtgcgccctctccctgaggaggtttgaggcgatccaccatgagctgctgcagtcagagctnccgagctcgagtatcacgcagtgaagactt

SEQ ID NO: 334359 - DNA, 416 bp, Homo sapiens
tggggctcactgagcatgtaccgggtgtttcagcacactccacagccggctcctgagtgaccagactcggctgaaggatgacgtggacatgctgaggcgggagaatgggcagctgctgcgggagcgaaacctgctgcagcagtcatgggaggacatgaagcggctccacgaggaggaccagaaggagatcggtgacctccgtgcccagcagcagcaggtaggcccagcccctggagactggccatttctcccaagtagtcctcattccttttaatggagaatagtattgagaagtaaatgctgggccgggcacgttggctcacatctgtgatcccagcgctttggaagaccaaggtgagagattgcttgagatgagcctgggcaacatggcaagatcccatctctacaaaaaaaaa

SEQ ID NO: 334360 - DNA, 785 bp, Homo sapiens
  misc_feature (755)..(755): n is a, c, g, or t
gcactaccgggaaggcgccgtccccaccacccctcctcactgaccggcaagtgaatgagaaggtggagaacctctccattcagctgcggctgatgacccgggagagaaacgagctccgcaagcgcctggcctttgctacgcatggcacggcctttgacaagaggccctaccacaggctgaatcctgactatgagaggctgaagatccagtgcgtgcgagccatgtcggacctgcagagcctgcagaaccagcacaccaacgccttgaagagcacactccacagccggctcctgagtgaccagactcggctgaaggatgacgtggacatgctgaggcgggagaatgggcagctgctgcgggagcgaaacctgctgcagcagtcatgggaggacatgaagcggctccacgaggaggaccagaaggagatcggtgacctccgtgcccagcagcagcaggtgttgaagcacaacgggtcatccgagattctcaacaaactgtatgacacggccatggacaagttggaggtggtcaagaaggactatgacgcccttcggaagaggtacagtgagaaagtcgccatccacaatgcagacctgagccgcctggagcagctgggggaggagaaccagcggttgctgaagcagacagagatgctgacccagcagagggacacggccatccagctgcagcaccagtgcgccctctccctgaggaggtttgaggcgatccaccatgagctgctgcagtcagagctnccgagctcgagtatcacgcagtgaagactt

SEQ ID NO: 334361 - DNA, 410 bp, Homo sapiens
gcatgtaccgggtgtttcagcacactccacagccggctcctgagtgaccagactcggctgaaggatgacgtggacatgctgaggcgggagaatgggcagctgctgcgggagcgaaacctgctgcagcagtcatgggaggacatgaagcggctccacgaggaggaccagaaggagatcggtgacctccgtgcccagcagcagcaggtaggcccagcccctggagactggccatttctcccaagtagtcctcattccttttaatggagaatagtattgagaagtaaatgctgggccgggcacgttggctcacatctgtgatcccagcgctttggaagaccaaggtgagagattgcttgagatgagcctgggcaacatggcaagatcccatctctacaaaaaaaaaaaaaaaa

SEQ ID NO: 334362 - DNA, 775 bp, Homo sapiens
caagatcgcgccactgcactccagcctgggtgacacagcaagactccacctcaaaaaaaaaaaaaaagaaattgatgtcatgttgggagagttcttttttataatgtataattctctcctttttcttttaaagagttaagtttaggttaatacgttttttaactctaatttactccaagcagggctataactgaatgaatattctgttctttttaaactaatattcaggtaaaaccacctcagctaattgattatctgcagcagaagaaaacagaaggttataccatcattggagtggaacaaactgccaaaagtttagacctaacccaatattgctttcctgagaaatctctgctcttgttgggaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagcaattgtggaaataaa

SEQ ID NO: 334363 - DNA, 5107 bp, Homo sapiens
atggagtgggtgctcgcggaagcgctgctctcgcagagccgggacccccgggccctgcttggggcgctgtgccaaggggaggcatccgcggagcgcgtggagacgctgcgcttccttctgcagcggctcgaggacgaggaggcgcgcggcagcgggggcgcaggcgcgctcccggaggcggcgcgcgaggtggctgcagggtacctcgtgccactgctgcggagcctgcgcggacgccccgcgggcggcccggaccccagtctgcagcctcgccaccgccggcgcgtgctgagggcggcgggcgcggccctgcgctcgtgcgtccgcctggccgggcgtccgcagctggcggccgcgctggctgaggaggcgctgcgcgatctgctcgccgggtggcgcgcgcctggcgccgaggctgccgtggaagtgctagcagccgtcgggccatgtttgcggccccgcgaggacgggccgctactggagcgggtggcggggaccgccgtcgccctggcgctgggcgggggcggggacggggatgaggccgggcctgccgaggacgcggcggcgctggtggccgggcgactgctgccagtgctggtccaatgtggcggggcggcgctgcgggccgtgtggggcgggctggccgcgcctggggcgtccctggggtccggccgcgtagaggagaagctgctggtcctgagcgccctggccgagaagctgttgcccgagcccggcggcgaccgcgcccgcggcgcgcgcgaggcgggcccggacgcccggcgctgctggcgcttctggaggacggtgcaggcggggctgggccaggcggacgccctgacgcgcaagcgagcgcgctacctgctgcagagggcggtggaggtgtcggcggagctgggggccgactgcacctgcgggccccaggaaggaaacggcccaagtctgttttggtggtctgagaggaaaaaagatgagcttctaaagttttgggaaaattatattttaattatggagactttagaaggaaatcagatacatgttataaagccagttttaccaaagctaaacaatctgtttgaatatgcggtgtcagaggaaaatggatgttggctctttcacccatcctggcatatgtgtatttataaaagaatgtttgaaagtgaaaacaaaatcctgtccaaagaaggtgttatccattttttggagctgtatgaaacaaagattcttccattttcaccagaattttctgagtttattattggaccattaatggatgcgctttcagagagctctctgtatagcaggtccccaggccagccaataggaagctgttctccattgggactgaaattacagaagtttttagtcacttatatttctcttcttccagaagaaataaagagtagcttcctattgaagtttattcggaagatgacaagtaggcattggtgtgctgttcccattttgtttctatctaaggctttggcaaatgtcccaagacataaggccctgggtatagatgggcttcttgctctcagggatgttattcattgcactatgatcacacatcagattctcctgagaggggcagcccaatgctaccttcttcaaacagctatgaatttgctagatgtggagaaagtgtcactttctgatgtctcaacttttctcatgtctctgagacaagaggaatccttaggacgaggaacttcattgtggacagagctgtgtgactggctacgtgttaatgaaagctattttaagccatcccctacgtgtagctccattggacttcacaagacatctttaaatgcttatgtaaagagcattgttcaagagtatgttaagtcatctgcttgggaaacaggagaaaactgctttatgcctgattggtttgaagccaagcttgtttctctgatggtcttgctggctgtggatgtggaaggaatgaagactcagtatagcggaaagcagagaacagagaatgtattgcggatattcttagaccctcttctggatgtgcttatgaagtttagtaccaatgcctacatgcccttgctgaagactgacagatgcctccagctgctgttgaagctgttgaacacatgcaggttgaaaggttccagtgcccaagatgatgaggtgtctactgttcttcagaactttttcatgtctactacagagagcatttctgaatttattctcagaagacttactatgaatgagctaaatagtgtttcagatctggatcgttgccatttatacctgatggtgttaactgagcttataaatctgcatttgaaggttgggtggaaaaggggtaaccctatctggagagttatttctcttttgaaaaatgcatccattcagcatcttcaagagatggacagtggacaggagccaacagttggaagtcagattcagagagtagtgagcatggctgccttggccatggtgtgtgaggccatagaccagaagcctgagctgcagctggactctctccatgctgggcccctggaaagcttcctttcctctcttcagctcaatcagacgctgcagaagccccacgcagaggagcagagcagttatgctcaccccttggagtgcagcagtgttttggaagaatcgtcatcttcccaaggatggggaaaaatagttgcacaatatattcatgatcaatgggtgtgcctctctttcctgttgaaaaaatatcacacccttataccaaccacagggagtgaaattctggaaccgtttctacctgccgttcagatgccaataaggactttgcagtctgcactagaagccctcacagttctttcttctgatcaagttttaccagtgttccattgcttgaaagtgttggttcccaagcttctgacttcctctgaatcactctgcatagagtcttttgacatggcgtggaaaattatatcttctttaagcaacactcagctgatattctgggctaatttaaaagcttttgttcagtttgtttttgataacaaagttcttaccattgctgccaaaatcaagggccaggcatatttcaaaataaaagagattatgtacaagataattgaaatgtctgctataaagactggagtcttcaatacactgataagttactgctgtcagtcttggatagtgtctgcttcaaatgtgtcccaaggatctttatcaagtgctaaaaattatagcgaacttatccttgaggcttgtatatttggaactgtgtttaggcgtgatcaaagacttgttcaggatgtacagaccttcatagaaaaccttggacatgactgtgcggcaaatattgttatggaaaatactaagagagaagaccattatgtgagaatttgtgctgtcaaattcctgtgtttattagatggctccaatatgtcccacaagttgtttattgaggatcttgcaatcaagctattagataaagatgaattagtgtccaagtccaaaaaacgctactatgtgaattctctacagcacagagtgaaaaaccgagtgtggcagactctgctggtacttttccctagacttgaccagaatttcttgaatggaattattgacaggattttccaggctggtttcaccaacaatcaagcatccataaaatattttatagaatggattattatattgattcttcataaattccctcaatttcttccaaagttctgggattgtttttcttatggtgaagaaaatcttaaaacaagcatttgtacgtttttagcagttttatcacatttagacattattactcaaaatattccagaaaagaaactaattctgaagcaagcccttatagttgtgctgcagtggtgtttcaatcacaattttagtgttcgactgtatgctttagttgctcttaagaaactctggactgtgtgtaaagtgttaagtgttgaagaatttgatgccctgactcctgtgattgaatccagcctccatcaagtggaaagcatgcacggagcagggaatgccaagaagaattggcaacgcattcaggagcatttcttttttgcaacatttcacccactcaaggattattgtctagagaccatattttacatccttccacgcctttcaggccttattgaagatgaatggatcaccattgataaatttaccagattcactgatgttcctttagctgcgggatttcagtggtacctttctcaaactcaacttagtaaactaaaaccaggtgactggtctcagcaagacataggtactaatttggttgaagcagataaccaagcagagtggaccgacgttcagaagaagattatcccgtggaacagtcgtgtttccgacttagacctggagctcctgtttcaggatcgtgctgccagacttggaaagtcaattagtagactcatcgttgtggcctcgctcatcgacaaaccgaccaatttaggaggactgtgcaggacctgtgaggtatttggggcttcagtgctcgttgttggcagccttcagtgtatcagcgacaaacagtttcagcacctcagtgtctctgcagaacagtggcttcctctagtggaggtaaaaccacctcagctaattgattatctgcagcagaagaaaacagaaggttataccatcattggagtggaacaaactgccaaaagtttagacctaacccaatattgctttcctgagaaatctctgctcttgttgggaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagcaattgtggaaataaa

SEQ ID NO: 334364 - DNA, 4935 bp, Homo sapiens
atggagtgggtgctcgcggaagcgctgctctcgcagagccgggacccccgggccctgcttggggcgctgtgccaaggggaggcatccgcggagcgcgtggagacgctgcgcttccttctgcagcggctcgaggacgaggaggcgcgcggcagcgggggcgcaggcgcgctcccggaggcggcgcgcgaggtggctgcagggtacctcgtgccactgctgcggagcctgcgcggacgccccgcgggcggcccggaccccagtctgcagcctcgccaccgccggcgcgtgctgagggcggcgggcgcggccctgcgctcgtgcgtccgcctggccgggcgtccgcagctggcggccgcgctggctgaggaggcgctgcgcgatctgctcgccgggtggcgcgcgcctggcgccgaggctgccgtggaagtgctagcagccgtcgggccatgtttgcggccccgcgaggacgggccgctactggagcgggtggcggggaccgccgtcgccctggcgctgggcgggggcggggacggggatgaggccgggcctgccgaggacgcggcggcgctggtggccgggcgactgctgccagtgctggtccaatgtggcggggcggcgctgcgggccgtgtggggcgggctggccgcgcctggggcgtccctggggtccggccgcgtagaggagaagctgctggtcctgagcgccctggccgagaagctgttgcccgagcccggcggcgaccgcgcccgcggcgcgcgcgaggcgggcccggacgcccggcgctgctggcgcttctggaggacggtgcaggcggggctgggccaggcggacgccctgacgcgcaagcgagcgcgctacctgctgcagagggcggtggaggtgtcggcggagctgggggccgactgcacctgcgggccccaggaaggaaacggcccaagtctgttttggtggtctgagaggaaaaaagatgagcttctaaagttttgggaaaattatattttaattatggagactttagaaggaaatcagatacatgttataaagccagttttaccaaagctaaacaatctgtttgaatatgcggtgtcagaggaaaatggatgttggctctttcacccatcctggcatatgtgtatttataaaagaatgtttgaaagtgaaaacaaaatcctgtccaaagaaggtgttatccattttttggagctgtatgaaacaaagattcttccattttcaccagaattttctgagtttattattggaccattaatggatgcgctttcagagagctctctgtatagcaggtccccaggccagccaataggaagctgttctccattgggactgaaattacagaagtttttagtcacttatatttctcttcttccagaagaaataaagagtagcttcctattgaagtttattcggaagatgacaagtaggcattggtgtgctgttcccattttgtttctatctaaggctttggcaaatgtcccaagacataaggccctgggtatagatgggcttcttgctctcagggatgttattcattgcactatgatcacacatcagattctcctgagaggggcagcccaatgctaccttcttcaaacagctatgaatttgctagatgtggagaaagtgtcactttctgatgtctcaacttttctcatgtctctgagacaagaggaatccttaggacgaggaacttcattgtggacagagctgtgtgactggctacgtgttaatgaaagctattttaagccatcccctacgtgtagctccattggacttcacaagacatctttaaatgcttatgtaaagagcattgttcaagagtatgttaagtcatctgcttgggaaacaggagaaaactgctttatgcctgattggtttgaagccaagcttgtttctctgatggtcttgctggctgtggatgtggaaggaatgaagactcagtatagcggaaagcagagaacagagaatgtattgcggatattcttagaccctcttctggatgtgcttatgaagtttagtaccaatgcctacatgcccttgctgaagactgacagatgcctccagctgctgttgaagctgttgaacacatgcaggttgaaaggttccagtgcccaagatgatgaggtgtctactgttcttcagaactttttcatgtctactacagagagcatttctgaatttattctcagaagacttactatgaatgagctaaatagtgtttcagatctggatcgttgccatttatacctgatggtgttaactgagcttataaatctgcatttgaaggttgggtggaaaaggggtaaccctatctggagagttatttctcttttgaaaaatgcatccattcagcatcttcaagagatggacagtggacaggagccaacagttggaagtcagattcagagagtagtgagcatggctgccttggccatggtgtgtgaggccatagaccagaagcctgagctgcagctggactctctccatgctgggcccctggaaagcttcctttcctctcttcagctcaatcagacgctgcagaagccccacgcagaggagcagagcagttatgctcaccccttggagtgcagcagtgttttggaagaatcgtcatcttcccaaggatggggaaaaatagttgcacaatatattcatgatcaatgggtgtgcctctctttcctgttgaaaaaatatcacacccttataccaaccacagggagtgaaattctggaaccgtttctacctgccgttcagatgccaataaggactttgcagtctgcactagaagccctcacagttctttcttctgatcaagttttaccagtgttccattgcttgaaagtgttggttcccaagcttctgacttcctctgaatcactctgcatagagtcttttgacatggcgtggaaaattatatcttctttaagcaacactcagctgatattctgggctaatttaaaagcttttgttcagtttgtttttgataacaaagttcttaccattgctgccaaaatcaagggccaggcatatttcaaaataaaagagattatgtacaagataattgaaatgtctgctataaagactggagtcttcaatacactgataagttactgctgtcagtcttggatagtgtctgcttcaaatgtgtcccaaggatctttatcaagtgctaaaaattatagcgaacttatccttgaggcttgtatatttggaactgtgtttaggcgtgatcaaagacttgttcaggatgtacagaccttcatagaaaaccttggacatgactgtgcggcaaatattgttatggaaaatactaagagagaagaccattatgtgagaatttgtgctgtcaaattcctgtgtttattagatggctccaatatgtcccacaagttgtttattgaggatcttgcaatcaagctattagataaagatgaattagtgtccaagtccaaaaaacgctactatgtgaattctctacagcacagagtgaaaaaccgagtgtggcagactctgctggtacttttccctagacttgaccagaatttcttgaatggaattattgacaggattttccaggctggtttcaccaacaatcaagcatccataaaatattttatagaatggattattatattgattcttcataaattccctcaatttcttccaaagttctgggattgtttttcttatggtgaagaaaatcttaaaacaagcatttgtacgtttttagcagttttatcacatttagacattattactcaaaatattccagaaaagaaactaattctgaagcaagcccttatagttgtgctgcagtggtgtttcaatcacaattttagtgttcgactgtatgctttagttgctcttaagaaactctggactgtgtgtaaagtgttaagtgttgaagaatttgatgccctgactcctgtgattgaatccagcctccatcaagtggaaagcatgcacggagcagggaatgccaagaagaattggcaacgcattcaggagcatttcttttttgcaacatttcacccactcaaggattattgtctagaggtactaatttggttgaagcagataaccaagcagagtggaccgacgttcagaagaagattatcccgtggaacagtcgtgtttccgacttagacctggagctcctgtttcaggatcgtgctgccagacttggaaagtcaattagtagactcatcgttgtggcctcgctcatcgacaaaccgaccaatttaggaggactgtgcaggacctgtgaggtatttggggcttcagtgctcgttgttggcagccttcagtgtatcagcgacaaacagtttcagcacctcagtgtctctgcagaacagtggcttcctctagtggaggtaaaaccacctcagctaattgattatctgcagcagaagaaaacagaaggttataccatcattggagtggaacaaactgccaaaagtttagacctaacccaatattgctttcctgagaaatctctgctcttgttgggaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagcaattgtggaaataaa

SEQ ID NO: 334365 - DNA, 5276 bp, Homo sapiens
atggagtgggtgctcgcggaagcgctgctctcgcagagccgggacccccgggccctgcttggggcgctgtgccaaggggaggcatccgcggagcgcgtggagacgctgcgcttccttctgcagcggctcgaggacgaggaggcgcgcggcagcgggggcgcaggcgcgctcccggaggcggcgcgcgaggtggctgcagggtacctcgtgccactgctgcggagcctgcgcggacgccccgcgggcggcccggaccccagtctgcagcctcgccaccgccggcgcgtgctgagggcggcgggcgcggccctgcgctcgtgcgtccgcctggccgggcgtccgcagctggcggccgcgctggctgaggaggcgctgcgcgatctgctcgccgggtggcgcgcgcctggcgccgaggctgccgtggaagtgctagcagccgtcgggccatgtttgcggccccgcgaggacgggccgctactggagcgggtggcggggaccgccgtcgccctggcgctgggcgggggcggggacggggatgaggccgggcctgccgaggacgcggcggcgctggtggccgggcgactgctgccagtgctggtccaatgtggcggggcggcgctgcgggccgtgtggggcgggctggccgcgcctggggcgtccctggggtccggccgcgtagaggagaagctgctggtcctgagcgccctggccgagaagctgttgcccgagcccggcggcgaccgcgcccgcggcgcgcgcgaggcgggcccggacgcccggcgctgctggcgcttctggaggacggtgcaggcggggctgggccaggcggacgccctgacgcgcaagcgagcgcgctacctgctgcagagggcggtggaggtgtcggcggagctgggggccgactgcacctgcgggccccaggaaggaaacggcccaagtctgttttggtggtctgagaggaaaaaagatgagcttctaaagttttgggaaaattatattttaattatggagactttagaaggaaatcagatacatgttataaagccagttttaccaaagctaaacaatctgtttgaatatgcggtgtcagaggaaaatggatgttggctctttcacccatcctggcatatgtgtatttataaaagaatgtttgaaagtgaaaacaaaatcctgtccaaagaaggtgttatccattttttggagctgtatgaaacaaagattcttccattttcaccagaattttctgagtttattattggaccattaatggatgcgctttcagagagctctctgtatagcaggtccccaggccagccaataggaagctgttctccattgggactgaaattacagaagtttttagtcacttatatttctcttcttccagaagaaataaagagtagcttcctattgaagtttattcggaagatgacaagtaggcattggtgtgctgttcccattttgtttctatctaaggctttggcaaatgtcccaagacataaggccctgggtatagatgggcttcttgctctcagggatgttattcattgcactatgatcacacatcagattctcctgagaggggcagcccaatgctaccttcttcaaacagctatgaatttgctagatgtggagaaagtgtcactttctgatgtctcaacttttctcatgtctctgagacaagaggaatccttaggacgaggaacttcattgtggacagagctgtgtgactggctacgtgttaatgaaagctattttaagccatcccctacgtgtagctccattggacttcacaagacatctttaaatgcttatgtaaagagcattgttcaagagtatgttaagtcatctgcttgggaaacaggagaaaactgctttatgcctgattggtttgaagccaagcttgtttctctgatggtcttgctggctgtggatgtggaaggaatgaagactcagtatagcggaaagcagagaacagagaatgtattgcggatattcttagaccctcttctggatgtgcttatgaagtttagtaccaatgcctacatgcccttgctgaagactgacagatgcctccagctgctgttgaagctgttgaacacatgcaggttgaaaggttccagtgcccaagatgatgaggtgtctactgttcttcagaactttttcatgtctactacagagagcatttctgaatttattctcagaagacttactatgaatgagctaaatagtgtttcagatctggatcgttgccatttatacctgatggtgttaactgagcttataaatctgcatttgaaggttgggtggaaaaggggtaaccctatctggagagttatttctcttttgaaaaatgcatccattcagcatcttcaagagatggacagtggacaggagccaacagttggaagtcagattcagagagtagtgagcatggctgccttggccatggtgtgtgaggccatagaccagaagcctgagctgcagctggactctctccatgctgggcccctggaaagcttcctttcctctcttcagctcaatcagacgctgcagaagccccacgcagaggagcagagcagttatgctcaccccttggagtgcagcagtgttttggaagaatcgtcatcttcccaaggatggggaaaaatagttgcacaatatattcatgatcaatgggtgtgcctctctttcctgttgaaaaaatatcacacccttataccaaccacagggagtgaaattctggaaccgtttctacctgccgttcagatgccaataaggactttgcagtctgcactagaagccctcacagttctttcttctgatcaagttttaccagtgttccattgcttgaaagtgttggttcccaagcttctgacttcctctgaatcactctgcatagagtcttttgacatggcgtggaaaattatatcttctttaagcaacactcagctgatattctgggctaatttaaaagcttttgttcagtttgtttttgataacaaagttcttaccattgctgccaaaatcaagggccaggcatatttcaaaataaaagagattatgtacaagataattgaaatgtctgctataaagactggagtcttcaatacactgataagttactgctgtcagtcttggatagtgtctgcttcaaatgtgtcccaaggatctttatcaagtgctaaaaattatagcgaacttatccttgaggcttgtatatttggaactgtgtttaggcgtgatcaaagacttgttcaggatgtacagaccttcatagaaaaccttggacatgactgtgcggcaaatattgttatggaaaatactaagagagaagaccattatgtgagaatttgtgctgtcaaattcctgtgtttattagatggctccaatatgtcccacaagttgtttattgaggatcttgcaatcaagctattagataaagatgaattagtgtccaagtccaaaaaacgctactatgtgaattctctacagcacagagtgaaaaaccgagtgtggcagactctgctggtacttttccctagacttgaccagaatttcttgaatggaattattgacaggattttccaggctggtttcaccaacaatcaagcatccataaaatattttatagaatggattattatattgattcttcataaattccctcaatttcttccaaagttctgggattgtttttcttatggtgaagaaaatcttaaaacaagcatttgtacgtttttagcagttttatcacatttagacattattactcaaaatattccagaaaagaaactaattctgaagcaagcccttatagttgtgctgcagtggtgtttcaatcacaattttagtgttcgactgtatgctttagttgctcttaagaaactctggactgtgtgtaaagtgttaagtgttgaagaatttgatgccctgactcctgtgattgaatccagcctccatcaagtggaaagcatgcacggagcaggacaaaatcatacatggaagctcagtatcaagcaagtgacgtggatggggtgagggagcggtgcaggacccagtgtctgtgaagcccccacggtggttcccatgtctgcctctctttccccgcacctgtcacggtgcagaagcaggctgcagtgtcataagcatctccaggaatgccaagaagaattggcaacgcattcaggagcatttcttttttgcaacatttcacccactcaaggattattgtctagagaccatattttacatccttccacgcctttcaggccttattgaagatgaatggatcaccattgataaatttaccagattcactgatgttcctttagctgcgggatttcagtggtacctttctcaaactcaacttagtaaactaaaaccaggtgactggtctcagcaagacataggtactaatttggttgaagcagataaccaagcagagtggaccgacgttcagaagaagattatcccgtggaacagtcgtgtttccgacttagacctggagctcctgtttcaggatcgtgctgccagacttggaaagtcaattagtagactcatcgttgtggcctcgctcatcgacaaaccgaccaatttaggaggactgtgcaggacctgtgaggtatttggggcttcagtgctcgttgttggcagccttcagtgtatcagcgacaaacagtttcagcacctcagtgtctctgcagaacagtggcttcctctagtggaggtaaaaccacctcagctaattgattatctgcagcagaagaaaacagaaggttataccatcattggagtggaacaaactgccaaaagtttagacctaacccaatattgctttcctgagaaatctctgctcttgttgggaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagcaattgtggaaataaa

SEQ ID NO: 334366 - DNA, 1974 bp, Homo sapiens
aaccatgtgattttagaaagcaagggattgcttgacatctccaggctgtgaagactaaagttcacaggaaaagactacaaggaaatttaaacagttttattattttccccctcatttcttaattttcctgccactactcagtactgtgtgggtccaggatcaccattagggaagacagagtagctcagaaatcagtagtgaggaggaggacagcactttgtgtggtatcttgctctaggagcattttcaagccatcagaagtgggactcttgaagactatttctgactttctcagcacaaattaagataataggagatggaggctccatttgaaaaacattttggttgtataatggttagcataaaacatacttttttcaagttaactcaggtactagagtatggggggcggggggaaatgtactgcagcattaatgaaaactagagctgggagaatgtgtttttccttgagtaaattgcaaatgcctgtgcaccgcatttgaccaggagggaagaatgagaggccctggtagcaaagccagtggaagaagttttactaggagcagttgtatcattcgtgtactttttttgtgtcatacaagtgagagtaaaatggtccatgtctgtgttttgaggaattttttgcctttcttttcagaaaactaattctgaagcaagcccttatagttgtgctgcagtggtgtttcaatcacaattttagtgttcgactgtatgctttagttgctcttaagaaactctggactgtgtgtaaagtgttaagtgttgaagaatttgatgccctgactcctgtgattgaatccagcctccatcaagtggaaagcatgcacggagcagggaatgccaagaagaattggcaacgcattcaggagcatttcttttttgcaacatttcacccactcaaggattattgtctagagaccatattttacatccttccacgcctttcaggccttattgaagatgaatggatcaccattgataaatttaccagattcactgatgttcctttagctgcgggatttcagtggtacctttctcaaactcaacttagtaaactaaaaccaggtgactggtctcagcaagacataggtactaatttggttgaagcagataaccaagcagagtggaccgacgttcagaagaagattatcccgtggaacagtcgtgtttccgacttagacctggagctcctgtttcaggatcgtgctgccagacttggaaagtcaattagtagactcatcgttgtggcctcgctcatcgacaaaccgaccaatttaggaggactgtgcaggacctgtgaggtatttggggcttcagtgctcgttgttggcagccttcagtgtatcagcgacaaacagtttcagcacctcagtgtctctgcagaacagtggcttcctctagtggaggtaaaaccacctcagctaattgattatctgcagcagaagaaaacagaaggttataccatcattggagtggaacaaactgccaaaagtttagacctaacccaatattgctttcctgagaaatctctgctcttgttgggaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagcaattgtggaaataaa

SEQ ID NO: 334367 - DNA, 2070 bp, Homo sapiens
aaccatgtgattttagaaagcaagggattgcttgacatctccaggctgtgaagactaaagttcacaggaaaagactacaaggaaatttaaacagttttattattttccccctcatttcttaattttcctgccactactcagtactgtgtgggtccaggatcaccattagggaagacagagtagctcagaaatcagtagtgaggaggaggacagcactttgtgtggtatcttgctctaggagcattttcaagccatcagaagtgggactcttgaagactatttctgactttctcagcacaaattaagataataggagatggaggctccatttgaaaaacattttggttgtataatggttagcataaaacatacttttttcaagttaactcaggtactagagtatggggggcggggggaaatgtactgcagcattaatgaaaactagagctgggagaatgtgtttttccttgagtaaattgcaaatgcctgtgcaccgcatttgaccaggagggaagaatgagaggccctggtagcaaagccagtggaagaagttttactaggagcagttgtatcattcgtgtactttttttgtgtcatacaagtgagagtaaaatggtccatgtctgtgttttgaggaattttttgcctttcttttcagaaaactaattctgaagcaagcccttatagttgtgctgcagtggtgtttcaatcacaattttagtgttcgactgtatgctttagttgctcttaagaaactctggactgtgtgtaaagtgttaagtgttgaagaatttgatgccctgactcctgtgattgaatccagcctccatcaagtggaaagcatgcacggagcagggaatgccaagaagaattggcaacgcattcaggagcatttcttttttgcaacatttcacccactcaaggattattgtctagaggcagtgtctggcttgtaaacaatggaagggaatatttaactctaaacagaaatctgttctgacattaaaaggaaatgagtgagaacatttgtgcagaccatattttacatccttccacgcctttcaggccttattgaagatgaatggatcaccattgataaatttaccagattcactgatgttcctttagctgcgggatttcagtggtacctttctcaaactcaacttagtaaactaaaaccaggtgactggtctcagcaagacataggtactaatttggttgaagcagataaccaagcagagtggaccgacgttcagaagaagattatcccgtggaacagtcgtgtttccgacttagacctggagctcctgtttcaggatcgtgctgccagacttggaaagtcaattagtagactcatcgttgtggcctcgctcatcgacaaaccgaccaatttaggaggactgtgcaggacctgtgaggtatttggggcttcagtgctcgttgttggcagccttcagtgtatcagcgacaaacagtttcagcacctcagtgtctctgcagaacagtggcttcctctagtggaggtaaaaccacctcagctaattgattatctgcagcagaagaaaacagaaggttataccatcattggagtggaacaaactgccaaaagtttagacctaacccaatattgctttcctgagaaatctctgctcttgttgggaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagcaattgtggaaataaa

SEQ ID NO: 334368 - DNA, 2018 bp, Homo sapiens
aaccatgtgattttagaaagcaagggattgcttgacatctccaggctgtgaagactaaagttcacaggaaaagactacaaggaaatttaaacagttttattattttccccctcatttcttaattttcctgccactactcagtactgtgtgggtccaggatcaccattagggaagacagagtagctcagaaatcagtagtgaggaggaggacagcactttgtgtggtatcttgctctaggagcattttcaagccatcagaagtgggactcttgaagactatttctgactttctcagcacaaattaagataataggagatggaggctccatttgaaaaacattttggttgtataatggttagcataaaacatacttttttcaagttaactcaggtactagagtatggggggcggggggaaatgtactgcagcattaatgaaaactagagctgggagaatgtgtttttccttgagtaaattgcaaatgcctgtgcaccgcatttgaccaggagggaagaatgagaggccctggtagcaaagccagtggaagaagttttactaggagcagttgtatcattcgtgtactttttttgtgtcatacaagtgagaaaactaattctgaagcaagcccttatagttgtgctgcagtggtgtttcaatcacaattttagtgttcgactgtatgctttagttgctcttaagaaactctggactgtgtgtaaagtgttaagtgttgaagaatttgatgccctgactcctgtgattgaatccagcctccatcaagtggaaagcatgcacggagcagggaatgccaagaagaattggcaacgcattcaggagcatttcttttttgcaacatttcacccactcaaggattattgtctagaggcagtgtctggcttgtaaacaatggaagggaatatttaactctaaacagaaatctgttctgacattaaaaggaaatgagtgagaacatttgtgcagaccatattttacatccttccacgcctttcaggccttattgaagatgaatggatcaccattgataaatttaccagattcactgatgttcctttagctgcgggatttcagtggtacctttctcaaactcaacttagtaaactaaaaccaggtgactggtctcagcaagacataggtactaatttggttgaagcagataaccaagcagagtggaccgacgttcagaagaagattatcccgtggaacagtcgtgtttccgacttagacctggagctcctgtttcaggatcgtgctgccagacttggaaagtcaattagtagactcatcgttgtggcctcgctcatcgacaaaccgaccaatttaggaggactgtgcaggacctgtgaggtatttggggcttcagtgctcgttgttggcagccttcagtgtatcagcgacaaacagtttcagcacctcagtgtctctgcagaacagtggcttcctctagtggaggtaaaaccacctcagctaattgattatctgcagcagaagaaaacagaaggttataccatcattggagtggaacaaactgccaaaagtttagacctaacccaatattgctttcctgagaaatctctgctcttgttgggaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagcaattgtggaaataaa

SEQ ID NO: 334369 - DNA, 5134 bp, Homo sapiens
atggagtgggtgctcgcggaagcgctgctctcgcagagccgggacccccgggccctgcttggggcgctgtgccaaggggaggcatccgcggagcgcgtggagacgctgcgcttccttctgcagcggctcgaggacgaggaggcgcgcggcagcgggggcgcaggcgcgctcccggaggcggcgcgcgaggtggctgcagggtacctcgtgccactgctgcggagcctgcgcggacgccccgcgggcggcccggaccccagtctgcagcctcgccaccgccggcgcgtgctgagggcggcgggcgcggccctgcgctcgtgcgtccgcctggccgggcgtccgcagctggcggccgcgctggctgaggaggcgctgcgcgatctgctcgccgggtggcgcgcgcctggcgccgaggctgccgtggaagtgctagcagccgtcgggccatgtttgcggccccgcgaggacgggccgctactggagcgggtggcggggaccgccgtcgccctggcgctgggcgggggcggggacggggatgaggccgggcctgccgaggacgcggcggcgctggtggccgggcgactgctgccagtgctggtccaatgtggcggggcggcgctgcgggccgtgtggggcgggctggccgcgcctggggcgtccctggggtccggccgcgtagaggagaagctgctggtcctgagcgccctggccgagaagctgttgcccgagcccggcggcgaccgcgcccgcggcgcgcgcgaggcgggcccggacgcccggcgctgctggcgcttctggaggacggtgcaggcggggctgggccaggcggacgccctgacgcgcaagcgagcgcgctacctgctgcagagggcggtggaggtgtcggcggagctgggggccgactgcacctgcgggccccaggaaggaaacggcccaagtctgttttggtggtctgagaggaaaaaagatgagcttctaaagttttgggaaaattatattttaattatggagactttagaaggaaatcagatacatgttataaagccagttttaccaaagctaaacaatctgtttgaatatgcggtgtcagaggaaaatggatgttggctctttcacccatcctggcatatgtgtatttataaaagaatgtttgaaagtgaaaacaaaatcctgtccaaagaaggtgttatccattttttggagctgtatgaaacaaagattcttccattttcaccagaattttctgagtttattattggaccattaatggatgcgctttcagagagctctctgtatagcaggtccccaggccagccaataggaagctgttctccattgggactgaaattacagaagtttttagtcacttatatttctcttcttccagaagaaataaagagtagcttcctattgaagtttattcggaagatgacaagtaggcattggtgtgctgttcccattttgtttctatctaaggctttggcaaatgtcccaagacataaggccctgggtatagatgggcttcttgctctcagggatgttattcattgcactatgatcacacatcagattctcctgagaggggcagcccaatgctaccttcttcaaacagctatgaatttgctagatgtggagaaagtgtcactttctgatgtctcaacttttctcatgtctctgagacaagaggaatccttaggacgaggaacttcattgtggacagagctgtgtgactggctacgtgttaatgaaagctattttaagccatcccctacgtgtagctccattggacttcacaagacatctttaaatgcttatgtaaagagcattgttcaagagtatgttaagtcatctgcttgggaaacaggagaaaactgctttatgcctgattggtttgaagccaagcttgtttctctgatggtcttgctggctgtggatgtggaaggaatgaagactcagtatagcggaaagcagagaacagagaatgtattgcggatattcttagaccctcttctggatgtgcttatgaagtttagtaccaatgcctacatgcccttgctgaagactgacagatgcctccagctgctgttgaagctgttgaacacatgcaggttgaaaggttccagtgcccaagatgatgaggtgtctactgttcttcagaactttttcatgtctactacagagagcatttctgaatttattctcagaagacttactatgaatgagctaaatagtgtttcagatctggatcgttgccatttatacctgatggtgttaactgagcttataaatctgcatttgaaggttgggtggaaaaggggtaaccctatctggagagttatttctcttttgaaaaatgcatccattcagcatcttcaagagatggacagtggacaggagccaacagttggaagtcagattcagagagtagtgagcatggctgccttggccatggtgtgtgaggccatagaccagaagcctgagctgcagctggactctctccatgctgggcccctggaaagcttcctttcctctcttcagctcaatcagacgctgcagaagccccacgcagaggagcagagcagttatgctcaccccttggagtgcagcagtgttttggaagaatcgtcatcttcccaaggatggggaaaaatagttgcacaatatattcatgatcaatgggtgtgcctctctttcctgttgaaaaaatatcacacccttataccaaccacagggagtgaaattctggaaccgtttctacctgccgttcagatgccaataaggactttgcagtctgcactagaagccctcacagttctttcttctgatcaagttttaccagtgttccattgcttgaaagtgttggttcccaagcttctgacttcctctgaatcactctgcatagagtcttttgacatggcgtggaaaattatatcttctttaagcaacactcagctgatattctgggctaatttaaaagcttttgttcagtttgtttttgataacaaagttcttaccattgctgccaaaatcaagggccaggcatatttcaaaataaaagagattatgtacaagataattgaaatgtctgctataaagactggagtcttcaatacactgataagttactgctgtcagtcttggatagtgtctgcttcaaatgtgtcccaaggatctttatcaagtgctaaaaattatagcgaacttatccttgaggcttgtatatttggaactgtgtttaggcgtgatcaaagacttgttcaggatgtacagaccttcatagaaaaccttggacatgactgtgcggcaaatattgttatggaaaatactaagagagaagaccattatgtgagaatttgtgctgtcaaattcctgtgtttattagatggctccaatatgtcccacaagttgtttattgaggatcttgcaatcaagctattagataaagatgaattagtgtccaagtccaaaaaacgctactatgtgaattctctacagcacagagtgaaaaaccgagtgtggcagactctgctggtacttttccctagacttgaccagaatttcttgaatggaattattgacaggattttccaggctggtttcaccaacaatcaagcatccataaaatattttatagaatggattattatattgattcttcataaattccctcaatttcttccaaagttctgggattgtttttcttatggtgaagaaaatcttaaaacaagcatttgtacgtttttagcagttttatcacatttagacattattactcaaaatattccagaaaagaaactaattctgaagcaagcccttatagttgtgctgcagtggtgtttcaatcacaattttagtgttcgactgtatgctttagttgctcttaagaaactctggactgtgtgtaaagtgttaagtgttgaagaatttgatgccctgactcctgtgattgaatccagcctccatcaagtggaaagcatgcacggagcagggaatgccaagaagaattggcaacgcattcaggagcatttcttttttgcaacatttcacccactcaaggattattgtctagagaccatattttacatccttccacgcctttcaggccttattgaagatgaatggatcaccattgataaatttaccagattcactgatgttcctttagctgcgggatttcagtggtacctttctcaaactcaacttagtaaactaaaaccaggtgactggtctcagcaagacataggtactaatttggttgaagcagataaccaagcagagtggaccgacgttcagaagaagattatcccgtggaacagtcgtgtttccgacttagacctggagctcctgtttcaggatcgtgctgccagacttggaaagtcaattagtagactcatcgttgtggcctcgctcatcgacaaaccgaccaatttaggaggactgtgcaggacctgtgaggtatttggggcttcagtgctcgttgttggcagccttcagtgtatcagcgacaaacagtttcagcacctcagtgtctctgcagaacagtggcttcctctagtggaggtaaaaccacctcagctaattgattatctgcagcagaagaaaacagaaggttataccatcattggagtggaacaaactgccaaaagtttagacctaacccaatattgctttcctgagaaatctctgctcttgttgggaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagcaattgtggaaataaaacaatggattttttaagagagaattta

SEQ ID NO: 334370 - DNA, 5164 bp, Homo sapiens
atggagtgggtgctcgcggaagcgctgctctcgcagagccgggacccccgggccctgcttggggcgctgtgccaaggggaggcatccgcggagcgcgtggagacgctgcgcttccttctgcagcggctcgaggacgaggaggcgcgcggcagcgggggcgcaggcgcgctcccggaggcggcgcgcgaggtggctgcagggtacctcgtgccactgctgcggagcctgcgcggacgccccgcgggcggcccggaccccagtctgcagcctcgccaccgccggcgcgtgctgagggcggcgggcgcggccctgcgctcgtgcgtccgcctggccgggcgtccgcagctggcggccgcgctggctgaggaggcgctgcgcgatctgctcgccgggtggcgcgcgcctggcgccgaggctgccgtggaagtgctagcagccgtcgggccatgtttgcggccccgcgaggacgggccgctactggagcgggtggcggggaccgccgtcgccctggcgctgggcgggggcggggacggggatgaggccgggcctgccgaggacgcggcggcgctggtggccgggcgactgctgccagtgctggtccaatgtggcggggcggcgctgcgggccgtgtggggcgggctggccgcgcctggggcgtccctggggtccggccgcgtagaggagaagctgctggtcctgagcgccctggccgagaagctgttgcccgagcccggcggcgaccgcgcccgcggcgcgcgcgaggcgggcccggacgcccggcgctgctggcgcttctggaggacggtgcaggcggggctgggccaggcggacgccctgacgcgcaagcgagcgcgctacctgctgcagagggcggtggaggtgtcggcggagctgggggccgactgcacctgcgggccccaggaaggaaacggcccaagtctgttttggtggtctgagaggaaaaaagatgagcttctaaagttttgggaaaattatattttaattatggagactttagaaggaaatcagatacatgttataaagccagttttaccaaagctaaacaatctgtttgaatatgcggtgtcagaggaaaatggatgttggctctttcacccatcctggcatatgtgtatttataaaagaatgtttgaaagtgaaaacaaaatcctgtccaaagaaggtgttatccattttttggagctgtatgaaacaaagattcttccattttcaccagaattttctgagtttattattggaccattaatggatgcgctttcagagagctctctgtatagcaggtccccaggccagccaataggaagctgttctccattgggactgaaattacagaagtttttagtcacttatatttctcttcttccagaagaaataaagagtagcttcctattgaagtttattcggaagatgacaagtaggcattggtgtgctgttcccattttgtttctatctaaggctttggcaaatgtcccaagacataaggccctgggtatagatgggcttcttgctctcagggatgttattcattgcactatgatcacacatcagattctcctgagaggggcagcccaatgctaccttcttcaaacagctatgaatttgctagatgtggagaaagtgtcactttctgatgtctcaacttttctcatgtctctgagacaagaggaatccttaggacgaggaacttcattgtggacagagctgtgtgactggctacgtgttaatgaaagctattttaagccatcccctacgtgtagctccattggacttcacaagacatctttaaatgcttatgtaaagagcattgttcaagagtatgttaagtcatctgcttgggaaacaggagaaaactgctttatgcctgattggtttgaagccaagcttgtttctctgatggtcttgctggctgtggatgtggaaggaatgaagactcagtatagcggaaagcagagaacagagaatgtattgcggatattcttagaccctcttctggatgtgcttatgaagtttagtaccaatgcctacatgcccttgctgaagactgacagatgcctccagctgctgttgaagctgttgaacacatgcaggttgaaaggttccagtgcccaagatgatgaggtgtctactgttcttcagaactttttcatgtctactacagagagcatttctgaatttattctcagaagacttactatgaatgagctaaatagtgtttcagatctggatcgttgccatttatacctgatggtgttaactgagcttataaatctgcatttgaaggttgggtggaaaaggggtaaccctatctggagagttatttctcttttgaaaaatgcatccattcagcatcttcaagagatggacagtggacaggagccaacagttggaagtcagattcagagagtagtgagcatggctgccttggccatggtgtgtgaggccatagaccagaagcctgagctgcagctggactctctccatgctgggcccctggaaagcttcctttcctctcttcagctcaatcagacgctgcagaagccccacgcagaggagcagagcagttatgctcaccccttggagtgcagcagtgttttggaagaatcgtcatcttcccaaggatggggaaaaatagttgcacaatatattcatgatcaatgggtgtgcctctctttcctgttgaaaaaatatcacacccttataccaaccacagggagtgaaattctggaaccgtttctacctgccgttcagatgccaataaggactttgcagtctgcactagaagccctcacagttctttcttctgatcaagttttaccagtgttccattgcttgaaagtgttggttcccaagcttctgacttcctctgaatcactctgcatagagtcttttgacatggcgtggaaaattatatcttctttaagcaacactcagctgatattctgggctaatttaaaagcttttgttcagtttgtttttgataacaaagttcttaccattgctgccaaaatcaagggccaggcatatttcaaaataaaagagattatgtacaagataattgaaatgtctgctataaagactggagtcttcaatacactgataagttactgctgtcagtcttggatagtgtctgcttcaaatgtgtcccaaggatctttatcaagtgctaaaaattatagcgaacttatccttgaggcttgtatatttggaactgtgtttaggcgtgatcaaagacttgttcaggatgtacagaccttcatagaaaaccttggacatgactgtgcggcaaatattgttatggaaaatactaagagagaagaccattatgtgagaatttgtgctgtcaaattcctgtgtttattagatggctccaatatgtcccacaagttgtttattgaggatcttgcaatcaagctattagataaagatgaattagtgtccaagtccaaaaaacgctactatgtgaattctctacagcacagagtgaaaaaccgagtgtggcagactctgctggtacttttccctagacttgaccagaatttcttgaatggaattattgacaggattttccaggctggtttcaccaacaatcaagcatccataaaatattttatagaatggattattatattgattcttcataaattccctcaatttcttccaaagttctgggattgtttttcttatggtgaagaaaatcttaaaacaagcatttgtacgtttttagcagttttatcacatttagacattattactcaaaatattccagaaaagaaactaattctgaagcaagcccttatagttgtgctgcagtggtgtttcaatcacaattttagtgttcgactgtatgctttagttgctcttaagaaactctggactgtgtgtaaagtgttaagtgttgaagaatttgatgccctgactcctgtgattgaatccagcctccatcaagtggaaagcatgcacggagcagggaatgccaagaagaattggcaacgcattcaggagcatttcttttttgcaacatttcacccactcaaggattattgtctagagaccatattttacatccttccacgcctttcaggccttattgaagatgaatggatcaccattgataaatttaccagattcactgatgttcctttagctgcgggatttcagtggtacctttctcaaactcaacttagtaaactaaaaccaggtgactggtctcagcaagacataggtactaatttggttgaagcagataaccaagcagagtggaccgacgttcagaagaagattatcccgtggaacagtcgtgtttccgacttagacctggagctcctgtttcaggatcgtgctgccagacttggaaagtcaattagtagactcatcgttgtggcctcgctcatcgacaaaccgaccaatttaggaggactgtgcaggacctgtgaggtatttggggcttcagtgctcgttgttggcagccttcagtgtatcagcgacaaacagtttcagcacctcagtgtctctgcagaacagtggcttcctctagtggaggtaaaaccacctcagctaattgattatctgcagcagaagaaaacagaaggttataccatcattggagtggaacaaactgccaaaagtttagacctaacccaatattgctttcctgagaaatctctgctcttgttgggaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagcaattgtggaaataaacatgttatgcgtccagcatctcaaccgggtggcataaaaagtaaaagcgataaatgt

SEQ ID NO: 334371 - DNA, 4541 bp, Homo sapiens
atggagtgggtgctcgcggaagcgctgctctcgcagagccgggacccccgggccctgcttggggcgctgtgccaaggggaggcatccgcggagcgcgtggagacgctgcgcttccttctgcagcggctcgaggacgaggaggcgcgcggcagcgggggcgcaggcgcgctcccggaggcggcgcgcgaggtggctgcagggtacctcgtgccactgctgcggagcctgcgcggacgccccgcgggcggcccggaccccagtctgcagcctcgccaccgccggcgcgtgctgagggcggcgggcgcggccctgcgctcgtgcgtccgcctggccgggcgtccgcagctggcggccgcgctggctgaggaggcgctgcgcgatctgctcgccgggtggcgcgcgcctggcgccgaggctgccgtggaagtgctagcagccgtcgggccatgtttgcggccccgcgaggacgggccgctactggagcgggtggcggggaccgccgtcgccctggcgctgggcgggggcggggacggggatgaggccgggcctgccgaggacgcggcggcgctggtggccgggcgactgctgccagtgctggtccaatgtggcggggcggcgctgcgggccgtgtggggcgggctggccgcgcctggggcgtccctggggtccggccgcgtagaggagaagctgctggtcctgagcgccctggccgagaagctgttgcccgagcccggcggcgaccgcgcccgcggcgcgcgcgaggcgggcccggacgcccggcgctgctggcgcttctggaggacggtgcaggcggggctgggccaggcggacgccctgacgcgcaagcgagcgcgctacctgctgcagagggcggtggaggtgtcggcggagctgggggccgactgcacctgcgggccccaggaaggaaacggcccaagtctgttttggtggtctgagaggaaaaaagatgagcttctaaagttttgggaaaattatattttaattatggagactttagaaggaaatcagatacatgttataaagccagttttaccaaagctaaacaatctgtttgaatatgcggtgtcagaggaaaatggatgttggctctttcacccatcctggcatatgtgtatttataaaagaatgtttgaaagtgaaaacaaaatcctgtccaaagaaggtgttatccattttttggagctgtatgaaacaaagattcttccattttcaccagaattttctgagtttattattggaccattaatggatgcgctttcagagagctctctgtatagcaggtccccaggccagccaataggaagctgttctccattgggactgaaattacagaagtttttagtcacttatatttctcttcttccagaagaaataaagagtagcttcctattgaagtttattcggaagatgacaagtaggcattggtgtgctgttcccattttgtttctatctaaggctttggcaaatgtcccaagacataaggccctgggtatagatgggcttcttgctctcagggatgttattcattgcactatgatcacacatcagattctcctgagaggggcagcccaatgctaccttcttcaaacagctatgaatttgctagatgtggagaaagtgtcactttctgatgtctcaacttttctcatgtctctgagacaagaggaatccttaggacgaggaacttcattgtggacagagctgtgtgactggctacgtgttaatgaaagctattttaagccatcccctacgtgtagctccattggacttcacaagacatctttaaatgcttatgtaaagagcattgttcaagagtatgttaagtcatctgcttgggaaacaggagaaaactgctttatgcctgattggtttgaagccaagcttgtttctctgatggtcttgctggctgtggatgtggaaggaatgaagactcagtatagcggaaagcagagaacagagaatgtattgcggatattcttagaccctcttctggatgtgcttatgaagtttagtaccaatgcctacatgcccttgctgaagactgacagatgcctccagctgctgttgaagctgttgaacacatgcaggttgaaaggttccagtgcccaagatgatgaggtgtctactgttcttcagaactttttcatgtctactacagagagcatttctgaatttattctcagaagacttactatgaatgagctaaatagtgtttcagatctggatcgttgccatttatacctgatggtgttaactgagcttataaatctgcatttgaaggttgggtggaaaaggggtaaccctatctggagagttatttctcttttgaaaaatgcatccattcagcatcttcaagagatggacagtggacaggagccaacagttggaagtcagattcagagagtagtgagcatggctgccttggccatggtgtgtgaggccatagaccagaagcctgagctgcagctggactctctccatgctgggcccctggaaagcttcctttcctctcttcagctcaatcagacgctgcagaagccccacgcagaggagcagagcagttatgctcaccccttggagtgcagcagtgttttggaagaatcgtcatcttcccaaggatggggaaaaatagttgcacaatatattcatgatcaatgggtgtgcctctctttcctgttgaaaaaatatcacacccttataccaaccacagggagtgaaattctggaaccgtttctacctgccgttcagatgccaataaggactttgcagtctgcactagaagccctcacagttctttcttctgatcaagttttaccagtgttccattgcttgaaagtgttggttcccaagcttctgacttcctctgaatcactctgcatagagtcttttgacatggcgtggaaaattatatcttctttaagcaacactcagctgatattctgggctaatttaaaagcttttgttcagtttgtttttgataacaaagttcttaccattgctgccaaaatcaagggccaggcatatttcaaaataaaagagattatgtacaagataattgaaatgtctgctataaagactggagtcttcaatacactgataagttactgctgtcagtcttggatagtgtctgcttcaaatgtgtcccaaggatctttatcaagtgctaaaaattatagcgaacttatccttgaggcttgtatatttggaactgtgtttaggcgtgatcaaagacttgttcaggatgtacagaccttcatagaaaaccttggacatgactgtgcggcaaatattgttatggaaaatactaagagagaagaccattatgtgagaatttgtgctgtcaaattcctgtgtttattagatggctccaatatgtcccacaagttgtttattgaggatcttgcaatcaagctattagataaagatgaattagtgtccaagtccaaaaaacgctactatgtgaattctctacagcacagagtgaaaaaccgagtgtggcagactctgctggtacttttccctagacttgaccagaatttcttgaatggaattattgacaggattttccaggctggtttcaccaacaatcaagcatccataaaatattttatagaatggattattatattgattcttcataaattccctcaatttcttccaaagttctgggattgtttttcttatggtgaagaaaatcttaaaacaagcatttgtacgtttttagcagttttatcacatttagacattattactcaaaatattccagaaaagaaactaattctgaagcaagcccttatagttgtgctgcagtggtgtttcaatcacaattttagtgttcgactgtatgctttagttgctcttaagaaactctggactgtgtgtaaagtgttaagtgttgaagaatttgatgccctgactcctgtgattgaatccagcctccatcaagtggaaagcatgcacggagcagggaatgccaagaagaattggcaacgcattcaggagcatttcttttttgcaacatttcacccactcaaggattattgtctagaggcagtgtctggcttgtaaacaatggaagggaatatttaactctaaacagaaatctgttctgacattaaaaggaaatgagtgagaacatttgtgcagaccatattttacatccttccacgcctttcaggccttattgaagatgaatggatcaccattgataaatttaccagattcactgatgttcctttagctgcgggatttcagtggtacctttctcaaactcaacttagtaaactaaaaccaggtgactggtctcagcaagacatagaaaataattttcattttattttttccccttgttgatctggttagatttttttgatttaagttactaaggacaggtagttaataataatatcactttcattgacatggtgacctctgcctttccacttagggaaaagacagtgaaaaagtgtggtataactttgactaacacttttagtgaaacttagctttaaagctattta

SEQ ID NO: 334372 - DNA, 439 bp, Homo sapiens
gtttgttacaggaaaactaatctttcttccattttcttcctcagaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagc

SEQ ID NO: 334373 - DNA, 396 bp, Homo sapiens
ttgactagcttatgtttgttttggttttatatttttgtattatggaagcagggtgtcattaatttaatttacacattaattgggtataggatttccttcctgctggtgcctggcattgaagacagtggttcttccctgtgccttctttagtgagtcgccaccctcacgggaaagcacggaccagaagatgagtcctcatagctgctggttgtctgggtctttcatgagagtaactttgtctaattggatccattagctaaccagttttcacccaattataggtgggaagcaatttgcttatgcttttgaaatggttgattttggcatgtcttttaatgtctagcggaaagcagagaacagagaatgtattgcggatattcttagaccctcttctgg

SEQ ID NO: 334374 - DNA, 5203 bp, Homo sapiens
atggagtgggtgctcgcggaagcgctgctctcgcagagccgggacccccgggccctgcttggggcgctgtgccaaggggaggcatccgcggagcgcgtggagacgctgcgcttccttctgcagcggctcgaggacgaggaggcgcgcggcagcgggggcgcaggcgcgctcccggaggcggcgcgcgaggtggctgcagggtacctcgtgccactgctgcggagcctgcgcggacgccccgcgggcggcccggaccccagtctgcagcctcgccaccgccggcgcgtgctgagggcggcgggcgcggccctgcgctcgtgcgtccgcctggccgggcgtccgcagctggcggccgcgctggctgaggaggcgctgcgcgatctgctcgccgggtggcgcgcgcctggcgccgaggctgccgtggaagtgctagcagccgtcgggccatgtttgcggccccgcgaggacgggccgctactggagcgggtggcggggaccgccgtcgccctggcgctgggcgggggcggggacggggatgaggccgggcctgccgaggacgcggcggcgctggtggccgggcgactgctgccagtgctggtccaatgtggcggggcggcgctgcgggccgtgtggggcgggctggccgcgcctggggcgtccctggggtccggccgcgtagaggagaagctgctggtcctgagcgccctggccgagaagctgttgcccgagcccggcggcgaccgcgcccgcggcgcgcgcgaggcgggcccggacgcccggcgctgctggcgcttctggaggacggtgcaggcggggctgggccaggcggacgccctgacgcgcaagcgagcgcgctacctgctgcagagggcggtggaggtgtcggcggagctgggggccgactgcacctgcgggccccaggaaggaaacggcccaagtctgttttggtggtctgagaggaaaaaagatgagcttctaaagttttgggaaaattatattttaattatggagactttagaaggaaatcagatacatgttataaagccagttttaccaaagctaaacaatctgtttgaatatgcggtgtcagaggaaaatggatgttggctctttcacccatcctggcatatgtgtatttataaaagaatgtttgaaagtgaaaacaaaatcctgtccaaagaaggtgttatccattttttggagctgtatgaaacaaagattcttccattttcaccagaattttctgagtttattattggaccattaatggatgcgctttcagagagctctctgtatagcaggtccccaggccagccaataggaagctgttctccattgggactgaaattacagaagtttttagtcacttatatttctcttcttccagaagaaataaagagtagcttcctattgaagtttattcggaagatgacaagtaggcattggtgtgctgttcccattttgtttctatctaaggctttggcaaatgtcccaagacataaggccctgggtatagatgggcttcttgctctcagggatgttattcattgcactatgatcacacatcagattctcctgagaggggcagcccaatgctaccttcttcaaacagctatgaatttgctagatgtggagaaagtgtcactttctgatgtctcaacttttctcatgtctctgagacaagaggaatccttaggacgaggaacttcattgtggacagagctgtgtgactggctacgtgttaatgaaagctattttaagccatcccctacgtgtagctccattggacttcacaagacatctttaaatgcttatgtaaagagcattgttcaagagtatgttaagtcatctgcttgggaaacaggagaaaactgctttatgcctgattggtttgaagccaagcttgtttctctgatggtcttgctggctgtggatgtggaaggaatgaagactcagtatagcggaaagcagagaacagagaatgtattgcggatattcttagaccctcttctggatgtgcttatgaagtttagtaccaatgcctacatgcccttgctgaagactgacagatgcctccagctgctgttgaagctgttgaacacatgcaggttgaaaggttccagtgcccaagatgatgaggtgtctactgttcttcagaactttttcatgtctactacagagagcatttctgaatttattctcagaagacttactatgaatgagctaaatagtgtttcagatctggatcgttgccatttatacctgatggtgttaactgagcttataaatctgcatttgaaggttgggtggaaaaggggtaaccctatctggagagttatttctcttttgaaaaatgcatccattcagcatcttcaagagatggacagtggacaggagccaacagttggaagtcagattcagagagtagtgagcatggctgccttggccatggtgtgtgaggccatagaccagaagcctgagctgcagctggactctctccatgctgggcccctggaaagcttcctttcctctcttcagctcaatcagacgctgcagaagccccacgcagaggagcagagcagttatgctcaccccttggagtgcagcagtgttttggaagaatcgtcatcttcccaaggatggggaaaaatagttgcacaatatattcatgatcaatgggtgtgcctctctttcctgttgaaaaaatatcacacccttataccaaccacagggagtgaaattctggaaccgtttctacctgccgttcagatgccaataaggactttgcagtctgcactagaagccctcacagttctttcttctgatcaagttttaccagtgttccattgcttgaaagtgttggttcccaagcttctgacttcctctgaatcactctgcatagagtcttttgacatggcgtggaaaattatatcttctttaagcaacactcagctgatattctgggctaatttaaaagcttttgttcagtttgtttttgataacaaagttcttaccattgctgccaaaatcaagggccaggcatatttcaaaataaaagagattatgtacaagataattgaaatgtctgctataaagactggagtcttcaatacactgataagttactgctgtcagtcttggatagtgtctgcttcaaatgtgtcccaaggatctttatcaagtgctaaaaattatagcgaacttatccttgaggcttgtatatttggaactgtgtttaggcgtgatcaaagacttgttcaggatgtacagaccttcatagaaaaccttggacatgactgtgcggcaaatattgttatggaaaatactaagagagaagaccattatgtgagaatttgtgctgtcaaattcctgtgtttattagatggctccaatatgtcccacaagttgtttattgaggatcttgcaatcaagctattagataaagatgaattagtgtccaagtccaaaaaacgctactatgtgaattctctacagcacagagtgaaaaaccgagtgtggcagactctgctggtacttttccctagacttgaccagaatttcttgaatggaattattgacaggattttccaggctggtttcaccaacaatcaagcatccataaaatattttatagaatggattattatattgattcttcataaattccctcaatttcttccaaagttctgggattgtttttcttatggtgaagaaaatcttaaaacaagcatttgtacgtttttagcagttttatcacatttagacattattactcaaaatattccagaaaagaaactaattctgaagcaagcccttatagttgtgctgcagtggtgtttcaatcacaattttagtgttcgactgtatgctttagttgctcttaagaaactctggactgtgtgtaaagtgttaagtgttgaagaatttgatgccctgactcctgtgattgaatccagcctccatcaagtggaaagcatgcacggagcagggaatgccaagaagaattggcaacgcattcaggagcatttcttttttgcaacatttcacccactcaaggattattgtctagaggcagtgtctggcttgtaaacaatggaagggaatatttaactctaaacagaaatctgttctgacattaaaaggaaatgagtgagaacatttgtgcagaccatattttacatccttccacgcctttcaggccttattgaagatgaatggatcaccattgataaatttaccagattcactgatgttcctttagctgcgggatttcagtggtacctttctcaaactcaacttagtaaactaaaaccaggtgactggtctcagcaagacataggtactaatttggttgaagcagataaccaagcagagtggaccgacgttcagaagaagattatcccgtggaacagtcgtgtttccgacttagacctggagctcctgtttcaggatcgtgctgccagacttggaaagtcaattagtagactcatcgttgtggcctcgctcatcgacaaaccgaccaatttaggaggactgtgcaggacctgtgaggtatttggggcttcagtgctcgttgttggcagccttcagtgtatcagcgacaaacagtttcagcacctcagtgtctctgcagaacagtggcttcctctagtggaggtaaaaccacctcagctaattgattatctgcagcagaagaaaacagaaggttataccatcattggagtggaacaaactgccaaaagtttagacctaacccaatattgctttcctgagaaatctctgctcttgttgggaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagcaattgtggaaataaa

SEQ ID NO: 334375 - DNA, 1872 bp, Homo sapiens
ataactggtgggccaattatatcaatataataagaagagggaagggaaacctagtcggcaatgactctcttaattttccccgctacagtactaagagagaagaccattatgtgagaatttgtgctgtcaaattcctgtgtttattagatggctccaatatgtcccacaagttgtttattgaggatcttgcaatcaagctattagataaagatgaattagtgtccaagtccaaaaaacgctactatgtgaattctctacagcacagagtgaaaaaccgagtgtggcagactctgctggtacttttccctagacttgaccagaatttcttgaatggaattattgacaggattttccaggctggtttcaccaacaatcaagcatccataaaatattttatagaatggattattatattgattcttcataaattccctcaatttcttccaaagttctgggattgtttttcttatggtgaagaaaatcttaaaacaagcatttgtacgtttttagcagttttatcacatttagacattattactcaaaatattccagaaaagaaactaattctgaagcaagcccttatagttgtgctgcagtggtgtttcaatcacaattttagtgttcgactgtatgctttagttgctcttaagaaactctggactgtgtgtaaagtgttaagtgttgaagaatttgatgccctgactcctgtgattgaatccagcctccatcaagtggaaagcatgcacggagcagggaatgccaagaagaattggcaacgcattcaggagcatttcttttttgcaacatttcacccactcaaggattattgtctagagaccatattttacatccttccacgcctttcaggccttattgaagatgaatggatcaccattgataaatttaccagattcactgatgttcctttagctgcgggatttcagtggtacctttctcaaactcaacttagtaaactaaaaccaggtgactggtctcagcaagacataggtactaatttggttgaagcagataaccaagcagagtggaccgacgttcagaagaagattatcccgtggaacagtcgtgtttccgacttagacctggagctcctgtttcaggatcgtgctgccagacttggaaagtcaattagtagactcatcgttgtggcctcgctcatcgacaaaccgaccaatttaggaggactgtgcaggacctgtgaggtatttggggcttcagtgctcgttgttggcagccttcagtgtatcagcgacaaacagtttcagcacctcagtgtctctgcagaacagtggcttcctctagtggaggtaaaaccacctcagctaattgattatctgcagcagaagaaaacagaaggttataccatcattggagtggaacaaactgccaaaagtttagacctaacccaatattgctttcctgagaaatctctgctcttgttgggaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagcaattgtggaaataaa

SEQ ID NO: 334376 - DNA, 1922 bp, Homo sapiens
aaccatgtgattttagaaagcaagggattgcttgacatctccaggctgtgaagactaaagttcacaggaaaagactacaaggaaatttaaacagttttattattttccccctcatttcttaattttcctgccactactcagtactgtgtgggtccaggatcaccattagggaagacagagtagctcagaaatcagtagtgaggaggaggacagcactttgtgtggtatcttgctctaggagcattttcaagccatcagaagtgggactcttgaagactatttctgactttctcagcacaaattaagataataggagatggaggctccatttgaaaaacattttggttgtataatggttagcataaaacatacttttttcaagttaactcaggtactagagtatggggggcggggggaaatgtactgcagcattaatgaaaactagagctgggagaatgtgtttttccttgagtaaattgcaaatgcctgtgcaccgcatttgaccaggagggaagaatgagaggccctggtagcaaagccagtggaagaagttttactaggagcagttgtatcattcgtgtactttttttgtgtcatacaagtgagaaaactaattctgaagcaagcccttatagttgtgctgcagtggtgtttcaatcacaattttagtgttcgactgtatgctttagttgctcttaagaaactctggactgtgtgtaaagtgttaagtgttgaagaatttgatgccctgactcctgtgattgaatccagcctccatcaagtggaaagcatgcacggagcagggaatgccaagaagaattggcaacgcattcaggagcatttcttttttgcaacatttcacccactcaaggattattgtctagagaccatattttacatccttccacgcctttcaggccttattgaagatgaatggatcaccattgataaatttaccagattcactgatgttcctttagctgcgggatttcagtggtacctttctcaaactcaacttagtaaactaaaaccaggtgactggtctcagcaagacataggtactaatttggttgaagcagataaccaagcagagtggaccgacgttcagaagaagattatcccgtggaacagtcgtgtttccgacttagacctggagctcctgtttcaggatcgtgctgccagacttggaaagtcaattagtagactcatcgttgtggcctcgctcatcgacaaaccgaccaatttaggaggactgtgcaggacctgtgaggtatttggggcttcagtgctcgttgttggcagccttcagtgtatcagcgacaaacagtttcagcacctcagtgtctctgcagaacagtggcttcctctagtggaggtaaaaccacctcagctaattgattatctgcagcagaagaaaacagaaggttataccatcattggagtggaacaaactgccaaaagtttagacctaacccaatattgctttcctgagaaatctctgctcttgttgggaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagcaattgtggaaataaa

SEQ ID NO: 334377 - DNA, 3836 bp, Homo sapiens
atggagtgggtgctcgcggaagcgctgctctcgcagagccgggacccccgggccctgcttggggcgctgtgccaaggggaggcatccgcggagcgcgtggagacgctgcgcttccttctgcagcggctcgaggacgaggaggcgcgcggcagcgggggcgcaggcgcgctcccggaggcggcgcgcgaggtggctgcagggtacctcgtgccactgctgcggagcctgcgcggacgccccgcgggcggcccggaccccagtctgcagcctcgccaccgccggcgcgtgctgagggcggcgggcgcggccctgcgctcgtgcgtccgcctggccgggcgtccgcagctggcggccgcgctggctgaggaggcgctgcgcgatctgctcgccgggtggcgcgcgcctggcgccgaggctgccgtggaagtgctagcagccgtcgggccatgtttgcggccccgcgaggacgggccgctactggagcgggtggcggggaccgccgtcgccctggcgctgggcgggggcggggacggggatgaggccgggcctgccgaggacgcggcggcgctggtggccgggcgactgctgccagtgctggtccaatgtggcggggcggcgctgcgggccgtgtggggcgggctggccgcgcctggggcgtccctggggtccggccgcgtagaggagaagctgctggtcctgagcgccctggccgagaagctgttgcccgagcccggcggcgaccgcgcccgcggcgcgcgcgaggcgggcccggacgcccggcgctgctggcgcttctggaggacggtgcaggcggggctgggccaggcggacgccctgacgcgcaagcgagcgcgctacctgctgcagagggcggtggaggtgtcggcggagctgggggccgactgcacctgcgggccccaggaaggaaacggcccaagtctgttttggtggtctgagaggaaaaaagatgagcttctaaagttttgggaaaattatattttaattatggagactttagaaggaaatcagatacatgttataaagccagttttaccaaagctaaacaatctgtttgaatatgcggtgtcagaggaaaatggatgttggctctttcacccatcctggcatatgtgtatttataaaagaatgtttgaaagtgaaaacaaaatcctgtccaaagaaggtgttatccattttttggagctgtatgaaacaaagattcttccattttcaccagaattttctgagtttattattggaccattaatggatgcgctttcagagagctctctgtatagcaggtccccaggccagccaataggaagctgttctccattgggactgaaattacagaagtttttagtcacttatatttctcttcttccagaagaaataaagagtagcttcctattgaagtttattcggaagatgacaagtaggcattggtgtgctgttcccattttgtttctatctaaggctttggcaaatgtcccaagacataaggccctgggtatagatgggcttcttgctctcagggatgttattcattgcactatgatcacacatcagattctcctgagaggggcagcccaatgctaccttcttcaaacagctatgaatttgctagatgtggagaaagtgtcactttctgatgtctcaacttttctcatgtctctgagacaagaggaatccttaggacgaggaacttcattgtggacagagctgtgtgactggctacgtgttaatgaaagctattttaagccatcccctacgtgtagctccattggacttcacaagacatctttaaatgcttatgtaaagagcattgttcaagagtatgttaagtcatctgcttgggaaacaggagaaaactgctttatgcctgattggtttgaagccaagcttgtttctctgatggtcttgctggctgtggatgtggaaggaatgaagactcagtatagcggaaagcagagaacagagaatgtattgcggatattcttagaccctcttctggatgtgcttatgaagtttagtaccaatgcctacatgcccttgctgaagactgacagatgcctccagctgctgttgaagctgttgaacacatgcaggttgaaaggttccagtgcccaagatgatgaggtgtctactgttcttcagaactttttcatgtctactacagagagcatttctgaatttattctcagaagacttactatgaatgagctaaatagtgtttcagatctggatcgttgccatttatacctgatggtgttaactgagcttataaatctgcatttgaaggttgggtggaaaaggggtaaccctatctggagagttatttctcttttgaaaaatgcatccattcagcatcttcaagagatggacagtggacaggagccaacagttggaagtcagattcagagagtagtgagcatggctgccttggccatggtgtgtgaggccatagaccagaagcctgagctgcagctggactctctccatgctgggcccctggaaagcttcctttcctctcttcagctcaatcagacgctgcagaagccccacgcagaggagcagagcagttatgctcaccccttggagtgcagcagtgttttggaagaatcgtcatcttcccaaggatggggaaaaatagttgcacaatatattcatgatcaatgggtgtgcctctctttcctgttgaaaaaatatcacacccttataccaaccacagggagtgaaattctggaaccgtttctacctgccgttcagatgccaataaggactttgcagtctgcactagaagccctcacagttctttcttctgatcaagttttaccagtgttccattgcttgaaagtgttggttcccaagcttctgacttcctctgaatcactctgcatagagtcttttgacatggcgtggaaaattatatcttctttaagcaacactcagctgatattctgggctaatttaaaagcttttgttcagtttgtttttgataacaaagttcttaccattgctgccaaaatcaagggccaggcatatttcaaaataaaagagattatgtacaagataattgaaatgtctgctataaagactggagtcttcaatacactgataagttactgctgtcagtcttggatagtgtctgcttcaaatgtgtcccaaggatctttatcaagtgctaaaaattatagcgaacttatccttgaggcttgtatatttggaactgtgtttaggcgtgatcaaagacttgttcaggatgtacagaccttcatagaaaaccttggacatgactgtgcggcaaatattgttatggaaaatactaagagagaagaccattatgtgagaatttgtgctgtcaaattcctgtgtttattagatggctccaatatgtcccacaagttgtttattgaggatcttgcaatcaagctattagataaagatgaattagtgtccaagtccaaaaaacgctactatgtgaattctctacagcacagagtgaaaaaccgagtgtggcagactctgctggtacttttccctagacttgaccagaatttcttgaatggaattattgacaggattttccaggctggtttcaccaacaatcaagcatccataaaatattttatagaatggattattatattgattcttcataaattccctcaatttcttccaaagttctgggattgtttttcttatggtgaagaaaatcttaaaacaagcatttgtacgtttttagcagttttatcacatttagacattattactcaaaatattccagaaaaggtaagtttgtttgtaagaatttaaacttgactgtaaaaaaagaa

SEQ ID NO: 334378 - DNA, 833 bp, Homo sapiens
caggggatgggaaatgaatttccccaagttgaaaaccctgtacccttactttccttcccataaatttttctgtagttctaggtaaataataataataataaaaatgcaaattaggtgctttagaaggagtatgtaatatctgggactttttctaagttggtagacctaaaaaatgttttcaaaaatatatctagctgcatttctactgctgtcattccttaaagctcttcctccaaaaactccatatgaatgaatacatttaccaactcagtgattactaaataatagtactttatacttatacacagtaatacctttcatctaaggatctcaaatgccaatatattagtcatcaccctgtaaggtggatgacatattattcccattattccaatgggaaaattgggccatagaaaactgaggagcaaatgactcatctacaggaattaaatggaaaaaacaggctaggatttctcagcacactttaggagtgaatgaaaacttacaggcttcagttctactgctggccaccattggatttgtaagatccaggatgtgtattgaccacatgtgtccagacccaggcttagggcatctggaatgagagtggtgggctggtgtgtgggtctgaggatctggatgggagactgcattttcttctctgtgcaaaatatggaagtgtgaccttgaaggtgggcttagtctatggccttccccactcctgcttgaactgaagctggagagaatgggcatttttaaatgttacggcatatgctaatataatattatggcattaaataaaaacaagaagagaactgactaaaaccaaaaaa

SEQ ID NO: 334379 - DNA, 647 bp, Homo sapiens
gtgcacagggcagggaatggtagtggatagcagcaaacacttcggaagcacttcctatagaccagggcactctattaaatgatacatacgcacatgcgtgccagcacacacacgtctggttttcacaataacattatgaggtaggcagtattatcagcctcattttatagataaggacattgagacagagagtttaagtagtttgtcccagtcacacagctaagtgttggagctggtatttgaaacctggaggtctggttccatagcgatgactaataaccacttctctacggtgaggccctgattgagcttcagaacgcatttaataacatggcatgagctttttgattatgatgtgtgagtccaataacttctctgagtgctcagagccagtcccctgaggaaacttcttgcttcactaagaaacccctgtccggctgggcatggtggctcaagcctgtaatcccagcactttgggaggccgaggtgggtagatcacaaggtcaggagttcaagaccagcctggccaatatggtgaaaccccgtctccactaaaaatacaaaaattagctgggcgtggtggtgcaggcctgtagtcccagctgctcgggaggctaagcaggagaatcgcttgaacccaggaggcg

SEQ ID NO: 334380 - DNA, 286 bp, Homo sapiens
ttctgtcctcttaaaaggcctggacctagattccctggagtgtagtatgcaccgatcgcagaaatgttgagacatttcagatgttccccaaagctgcaaaactaaatagatacaccacaccacaatgtctctttgcgtacactcacagctagaagctaataactattaccttgttgctttttaaatatgtgtgcactcaagctttacagtaacttttgtgagcttcagtttggtcagagacggaagagaaaatattccaaacaaggccttggagtggaagaaggaa

SEQ ID NO: 334381 - DNA, 121 bp, Homo sapiens
atcagtattactgtcacgttttacaatgtatctcttaggaaatggtgagagccatccacacaatgtgcatttaaaggagactctactataatttcagctttcctactctttatagaaacca

SEQ ID NO: 334382 - DNA, 394 bp, Homo sapiens
ttagagtgggcatggctagagatatggagtctgaacaatacttttagtaagagaggcctagagcctaaactgtaggacagggtggatggacactggggagacagaattggtaggatttagtatctgattaggtatgagggggttggggacccagagggagaataatttagaatggtttccatattcctggcttagaagagaaacaggtgtgtaggctagaataactggatttggacattcaaccagctgtggatcatacaggtagagatatccatcaggaatctgcagctcagcaaagaggtctgagctgaaaataaaactcgcttaaattatgcacataaaagtggtggtcacagaaagcaggtagaagaagaagaaaagggggttaaggaca

SEQ ID NO: 334383 - DNA, 555 bp, Homo sapiens
acaaacaaacaaacaaacaaacaaacaaacaaaggcatatttagaagaaatgtgacaaggagtacaggccagacctctggatctgtagcaaggtacaacatgggtatgtttttactatttgtgtggcaccttagtgctctgtggtaggttgtaagtgctcagtaaatgtttattgtggctattatcattactagtattatttagaattcaatgggaaaggttagtatggagagttcacagttgggttagaatatactctaaaatctttatttttttaaattgtggagatttactttaaggctataaacaaattgtctctagttaaaacaagcagttagttaatcctttctatagcttagtcctaatatagtagtgtgacactagtaattgcttttagtcttagaggttagtaagtaggactgtttcttattaacttgttagggcagcatgaaatgccttgcctacccagggtgcattccattggactaagcaattagaaattagaacaggattactggtagttcatttcttctatactactgctaaagttctgat

SEQ ID NO: 334384 - DNA, 128 bp, Homo sapiens
aaaaatcctgtgcatgagtcgctaagtccagcccatactccaggggatggcaattgggtgccacctcctgaaggagcattagaggatttgtggacctacactgaaaccagtacagcacctctgggtgg

SEQ ID NO: 334385 - DNA, 473 bp, Homo sapiens
aggattcctcatcttccagatgtgcaggctgaaatatttatggatgaaattgtcagatgcctagcatttgctccatgataatctgaggtaaggaagacagtggcaatagctaccttaactttacttccatcttcatgaaatagtacattcttttacttctaattctaattcatcaaggtgaaaaacatcacttattcaccatccagtggttttaggcactatgctgagctacacatacagaaaatgcagagacttggttcttgtggtcaagttactcagtctggcagggaggcagggagacaggcagacccactactgtgaggagtgatgtacctggtgctttccaccagttgccatggggctgatcctcctactgaccttgtaatactaatgttctgaattttgatgggaaatattgtttttaacattgtgtgaaaagccacttccttattgtacagaaaccactaacatac

SEQ ID NO: 334386 - DNA, 215 bp, Homo sapiens
aggattcctcatcttccagatgtgcaggctgaaatatttatggatgaaattgtcagatgcctagcatttgctccatgataatctgagagaaaaggccatgtgaagacacagtgagaaggccgccatttaaaagtgaagaagagaggccttaggagaaaccaataccagcagcacttggatcctggactccaagtctccagaactgtgagaaatac

SEQ ID NO: 334387 - DNA, 472 bp, Homo sapiens
aacaccaggagagctggcatctgacgatgtctgtgggacacagtgcataggtagattttaacacactgagattgctatttggtataatgacatgtttatcctgaagaaatgaagttaggaattttctgagctacagaatgaattttttggttctcatcgaaaggtctgttgctcttggaactcaattctcaaaggtctgtttcacaaataatcatcctcgttctgatgtttattcaaatctttgcccaccctcgagtctccttaaattcctcatattccacaaatgatgtgtgttatctgaatccagaaaaccctcatgggtttgcagatataactgccaacaactgatatagaaatagagagtgtagaaaatatttcttgacaataaaagtcagaaggaagattcgagttatcctatccccatgaaaggaaggggataggatacacgttcgcgaggggatcctcagagtgc

SEQ ID NO: 334388 - DNA, 293 bp, Homo sapiens
aagagcagtcccaggaacctggaaggagggggagagacagggcatgaaggtgggatcctaaatcccagaatcgtcggcaacataataaatggcaacaccaggagagctggcatctgacgatgtctgtgggacacagtgcataggtagattttaacacactgagattgctatttggtataatgacatgtttatcctgaagaaatgaagttaggaattttctgagctacagaatgaattttttggttctcatcgaaaggtctgttgctcttggaactcaattctcaaaggtctgt

SEQ ID NO: 334389 - DNA, 409 bp, Homo sapiens
ttcattggtcactaactttcagcattgctatctgcttttgatatctgataagagtttttcatggacattcctcatttatgcccatccacagttccctagtaatggctccactctcctcccaatttcccaagcaggaaaccataggggtgattttgtcttctttttctctcagcccagatccaataggtaccaggaccttcaaggtaaggtctgaaattcaaacctgttttatctctcccctgctctgcttccactgctggaccctgcttccagtcctcatcgaaactttggcacagatactctgattaatatcttaattaccttactttctcatatcccctataccagtccattttatatcctcaagccaatgttgacttcctacttcacaattctgcttctgtttctc

SEQ ID NO: 334390 - DNA, 285 bp, Homo sapiens
gcactaacaagacttgaattttttgaaagagcactctggccatactgtggaggatgggtgtgaggacagtaaggcgagcctgctaaatctaagcctaggctgaagggggcctgtggtggcaatgggtactaagaaaaatctgtattgatggcatgcatttcttgaacttcagatctttatgggctgacccttggtgcttctttaatatcctatcaaacttccatctggccttcttgaccaaagaggaaaaagaccaaatcctctggggccctgctggatgggatg

SEQ ID NO: 334391 - DNA, 163 bp, Homo sapiens
ctcccatttctctcaggtaaaggaaatctggaggtaggctgtccacaaatggtatggtatcttcgggttgtcattgagcactcagtctcatgttttcatcctaccatacacagcacacagctttcattttcaaggtcacatcatgatccagattcgctggtgg

SEQ ID NO: 334392 - DNA, 322 bp, Homo sapiens
gcctattcttatttcagggcacaaaagggagcaatcatttatattaacatcttccagaacagttatagaattaaccaaattcctagatccatctttaaatgaaggtatttcctttgttttcaaaattatgtacatgaataaatttcttctttgaagcacacatcccactgagttttatattccaatcaaaaccagttggagttaagtctaaataacatcttcatccaactcctaagactcattcttgtccccttatttatccattcacacatttattcaacaaatacatacttaaacaaatacttttcacaagacattaaac

SEQ ID NO: 334393 - DNA, 264 bp, Homo sapiens
atggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcag

SEQ ID NO: 334394 - DNA, 307 bp, Homo sapiens
tgcttctgctcccctgtgtgtgccctcctcatcctccagcctgtgctcaggtatcacctcctccaaggagccttatctgattctgtgtagcttctctctcaagagcacttcccttcctctctccctgctcaccctctggtgtagcagcactcattgttccagttgcttccctgcctcacagataggcttcagtttcattgaggacaggagtcttgtcctgttcagcacccactgcagagcctgtcagagcacaagtgttgggagaaataaatgaattgttacggctcacaggtcccattttctttgc

SEQ ID NO: 334395 - DNA, 886 bp, Homo sapiens
gggatgatatctatctcctagtgttgtagaaagtaagagttaatatacgtgaacaaatgatggctggcattcaagtgtcgctctgtgaccctcagaaggtgttcacatccatgagctcatctgaacttcacagcagggcaggcattattataatttccattggcagacaagaaacctgaggttcagagaatacaaatgacctgatagagatcacctgactattaaggtagagctggatctggagcccagcctgacgtctgccactgtcttttgctgtccacttaaaagagcagcttgcacacgtgcagggctacatagggttcaaaggcctttcatgcccattaactgcttattcttcctagaaggatgcataagcccaaagttttgctatatatgaagacatgattttcatgagattcctgcagccaatgaagaaacaagccttcagtaatcatgtggatccatggtttagttgtcccttatgggtgacaggtgatgggttatgaggattagataagagctgtttgtaagaatgtctacaaggtgcagtgacaggctctggtcagatattttgatcatgctacagtgcatgaaattgttcataagaattgtatgtgcatctgtatctaacaggatctgcttatatcttcagaaaactttgtcataaatttaaattacttaaagtgtctgatcttcagatactttaagtagtgcatttgagaatgggaatgttgattacagtgcgtatagggaaatagatgaatattccattaataactattaaaatctgctaaagcttaggctaagctgaatatatttagttgtaataaaattgggtgaacacattccaacttcagcctgattaagggaaagggtgtaggggtga

SEQ ID NO: 334396 - DNA, 507 bp, Homo sapiens
gggatgatatctatctcctagtgttgtagaaagtaagagttaatatacgtgaacaaatgatggctggcattcaagtgtcgctctgtgaccctcagaaggtgttcacatccatgagctcatctgaacttcacagcagggcaggcattattataatttccattggcagacaagaaacctgaggttcagagaatacaaatgacctgatagagatcacctgactattaaggtagagctggatctggagcccagcctgacgtctgccactgtcttttgctgtccacttaaaagagcagcttgcacacgtgcagggctacatagggttcaaaggcctttcatgcccattaactgcttattcttcctagaaggatgcataagcccaaagttttgctatatagtcacttatgagccacaaccacatgaccactctacgtaacacatgccatctgtccccattcccaccatgctcatttctttctttttgtaacaaggtcattgcatttattgccc

SEQ ID NO: 334397 - DNA, 367 bp, Homo sapiens
tcctcaaaggtctactcattggagtctccacatctgtgaaaggaggggatgatatctatctcctagtgttgtagaaagtaagagttaatatacgtgaacaaatgatggctggcattcaagtgtcgctctgtgaccctcagaaggtgttcacatccatgagctcatctgaacttcacagcagggcaggcattattataatttccattggcagacaagaaacctgaggttcagagaatacaaatgacctgatagagatcacctgactattaaggtagagctggatctggagcccagcctgacgtctgccactgtcttttgctgtccacttaaaagagcagcttgcacacgtgcagggctacatagggtt

SEQ ID NO: 334398 - DNA, 479 bp, Homo sapiens
caagttccctgagatggcaggagggacacacagcatggatgaatttgtaattttgtgctccaagcagcactgaggtattcatgtatgtgattctcttcacaacttcttaattgctgcaaaacacctgctttgaaaggatactgagacatcagtcatctagacaaatgcctctaaactgttgagatcatgtgcccatctcaacagaaaattttgagcagttccttaatgtacatgtaagagaaaatggaaaatgaccctgatgaacagccagtacattaaggtagcaattgaacctaaaggctcatagactagaaataatattagacaaatgcactctgcgaccacatttggacaagacagagacaaggccacaatacttaatgtctccctcttctgactgacatgtgtgacagttgctcattcaccaataacaactctagcctcgctttcattctctcgcctttcagatagaaattata

SEQ ID NO: 334399 - DNA, 582 bp, Homo sapiens
cccagcagggctcttaaccctgaacaaagactgagatccttgagccaaaagctaaatctcaccaagtaggaacagaaaaggccaaatacaaggaaaatgcaattgggaagatgtaggaataaagtaatcttacatacatctttcattaaaaaactgctgcaatgaacaggaaaaaaagtcataagagagaatcaagccaaaacattagctatgaaaaatttaagatttaaaaaataaaagacataatagatggcctgaatatcaggatggatacaactgaagaatttgcgagtagataggatgatcagattgagaattatccccaaaagcaacagggaaagaaacagagacaacacatagaaaagagaagctgagagaggccaggcgcagtggctcacgcctgtaatcccagcacttggggaggctgaggcaggcagatcatttgagatcaggagtttgataccagcctggccaatatggtgaaaccccatcactactaaaaatacaaaaattagctcggtgtggtggtgggcgcctgtaattccagctactcgggaggctgaggcaagagaagaatcactt

SEQ ID NO: 334400 - DNA, 530 bp, Homo sapiens
ccatgttggtcaggctggtcttgaactcctgacctcaagtgatccacccgcctcggcctcccaaagtgctggggttacgggcgtgagccaccgtgcttggccatctcacttgttttgaatcaggatgcctaggtcagtgagagcctgtgtgagccaaaaacagccacgttcatctttgaaaaaacttaggccgacaaatcaagtttttaattacaggaaataatcaccaactactggagatgcaattaaaggcatttttctctgagagtagcttgtttgtcttttatatttttccccaaagctcattataaaaaatactatgttctttcatacttacagtctcaactctatcacttcctgctgtgagtatggaaatgaattttgttgaaatcaaagaaattagttaataagattttttttagcctgttagtagaagtggcttaaagtttataaagaatatttgctttgctcataatttaactgaatgagacatctgacctctgctgtctatcaaattcattaccgctttc

SEQ ID NO: 334401 - DNA, 403 bp, Homo sapiens
ctgctccttgcctgggtggtgcttaagaaaaattgcctgacattgttcccagtcatccttaaataaaagttcaggcacagtcagctcttcttgattccccatcagtctctcacattctctcaccaactgtctgaaatctttacaagtttcctcaaacactcaacctaacactcagcaaactgtctgttatgatcctttcaaggaactagagtccattaggcatgcgacctattaatttcgttcatctccatgtcaaagtttaactaattaatcagccatcctttcttccttttttcttatctcacaggaaaaaagattaacctcctttctttttttcttttctttttcttttttttcttttttgagacaaagtctcactctgtcgtccaggctggagtgcagt

SEQ ID NO: 334402 - DNA, 302 bp, Homo sapiens
gagtttaaatattttctatgtagaattggaagtcattaaaaggtttaagcagggaaaagacatgaactggttttgttttgtgttttaaagatcactctagctactctctgatgaatggattgttgggatggggttgcagcagagagatcagcgaggcagccactgcaataagatgggcagtagataagatgacttgggttgggatggtagcaagaggagaccaggagaataaaacagcttaaggtgcattttagatgtagaatcaacaggacttgctcatagactgaataacaggaatgaag

SEQ ID NO: 334403 - DNA, 1096 bp, Homo sapiens
  misc_feature (1094)..(1095): n is a, c, g, or t
gcatctgcaggtgattttgatgcccagccatgtttggggaaaaaagtttgggttctgagtgaaaatagaaaacgtaatgacatggaaaggaagtcaggggataagaaaagctctatggccagccatggtggctcacacctgtaatcccagcactttgggaggctgagatgggcagatggcttgggctcacgagtttgagaccagcctaggcaacatggcaaaaccatgttcctattcaggaacaaagaatagatcacaaattaaactctgtgggttttcataagtggaaagttggctttcgttgttctgtatttggggtgcttagtggacaggagttatctaaaagaagtaattatagttgtaatgcgggaccctccaaagttggaaagtagattgaaatcccattattttacaaggtggcccttacctatttatagtttgactgtaggtatggcagtgagagataaaattactttttcctagctttgcaaaacgcccaaacgtctttgaaattaagagtaaaaggggtttaaaatatgtactgctttataaagcaggaaaaccccactggaacattttgggtgtttacagaaatgggtattccatgggagagaacgtggtaacctatgttttgtcatcatttgtttaatcactgaaaatatattaacaggccaggcatggtagctcatgcctgtaatcccagcgctttggcaggctgaggtgggaggattgcttgagcccaggagtttgagatcagcttgggaaacacagtgagactccatttctacaaaaaaagaaaaaagaaaaaaaagtcacatgtggtggcacacccctgtggtcccagctactttggaggctaaggtgggaggatagctcgagccccagagatcaaggccgccgtgaactgtgatcgcaccactgcactccaggctgagcaacagatcaagactcttgtataaaaaagaaaaaaaaattttttaaaaatataaatatagattaacaaagtaacagggaatataatattttcaggttggtcatatagaggaaatactatattgtgttattcagcttaataaaatataaaacaaaaaaanna

SEQ ID NO: 334404 - DNA, 167 bp, Homo sapiens
ctactgacacttctcctctatagtgagccacagtgagggggaggccagtcagcagccatatggagtggggttctgcttccctgatccaaataggttgttttctctgtgtacaaactagacctttatagagcttcaagctgttctttactaaagagtcaagtgaacat

SEQ ID NO: 334405 - DNA, 377 bp, Homo sapiens
accccagaatggtggatccactggcagtttgcaccctgaatctggaaaagccacaggcactcaactctatcatgtgagagaagccacaggggcaacatcctccaaagccacaagggtagagttttccaaggccttgggagcccaccccctgcaccaatgtgccctggatatgggacatgaagtcaaaggagattaccttggagctttaagatttaatgactgccctgctggatttctgacatatatggggcatgtagatcctttctttttgccaacttctcccttgtggaatgggaatgtttacgcaatgtctgcactctcattgtattttgggagtcaataatttgtgtttgatttcataggctgataggtggaag

SEQ ID NO: 334406 - DNA, 334 bp, Homo sapiens
gtacaaataagcacaacagaaatgcccgtcaaagataacgtccttctacttagtagccataatcctaagcttattctcttttttccttaactcttttaccattgccaataaggagaagttaaatagattataatcttaaaatgcacttttattcttggttgattaagctgggcaacaaaaatccccatgtgggccaggcacagtgactcaggcctctaattccagcactttgagagggccatgtgggtggatcacttgaggtcaggagttcgagaccagcctatgctctactgtttaatgagaacacacatgttgtagcaaagaccccaaaagg

SEQ ID NO: 334407 - DNA, 579 bp, Homo sapiens
tagcagttctttttaaagaactcaaaaacatgatgcaggattactgcatttttcgatgttatcctttattgagtaaattacactagtaatttaattctagggggaaaagtcctaatctattttcctatcttgtccatattcaatattgcatttttctttgtttctagatatgctattatcctaacacaaccctttgaacctacttaatattccctagagaataatagtatatcactttctcctgtcaattattttatataccaggcaacaatattatttcttgatcctcagtacaagacttccgagttacagtgctaagtaaacatttacagaattccttaatttctcaaaccaaaataaaagttctaagtcaagcaattgttttctaagttctagattttaatacaaacagccaaaaggagattgtactttccttttgctttgccaaaatctgcaaaaattttgccaaaaatattccaggcaataatctcatgaaatatatactcaacttaccaaagtacagtatttttacagtgctcaggcttgagaaattaaatatgaatcataaatgctgagagc

SEQ ID NO: 334408 - DNA, 112 bp, Homo sapiens
taggcactgtgagaaaatgggcacagcagtgaacaaaatgcacgtcagtgaacaaaatgccgggcgcggtggcacgtgcctgtagtcccagctacttgggaggctgaggctg

SEQ ID NO: 334409 - DNA, 1201 bp, Homo sapiens
cttgattgttgggggccttggaattctactcaaagtcatttctgggtggctacaacatccccaagcttagatgcctcttggcttgcttgtggaagcctgtgtgccctgtacggtgagagggagaaaccaagattctctttgagctttctgtggctcctcttccaactgggaaaccttaataagactcagtctccacctctatgtggtgagaagaatggtatcttccctactgacctctctaggtcaagtgatatgttgcttttgaaagttcttggaaaagtttagagagcaactcaaaaagaggccctcgccaagctcagtctcctcagccccagagatctggaagcccctcccaacagaggctctccccacaaggccagcagcccctgagcccccagtccggatctccacagcagcaaaggtcaccaggctctccgcagctatcccgggcatccagtggcagctccccaaaccaggcctccaagccaggtgccaccctcgcctcacagccccggccccctgtgcagggccgtagtacctcccagcagggtgaagagtccaagaagccagcaccaccccatccgcatctcaacaaatctcagtccctgactaacagcctcagcacatccgacacctcccagcgtgggaccccaagtgaagacgaggccaaggctgaaaccatccgcaacctgaggaagtcttttgccagcctgttctctgactaacgccatccaggctgggaggggaagagtgctctgctacactcgtccccctcctgcctcatcttccttctcagccttggttcctgatgggaacagaatggagggcctgagaacatactttctaaatgcctttgacccaggaaccgattatctatatttgttcccattttccttcaccgtgacattccagcattgtctgactgtgaggtgggcctttgagagcctccaggttcctcaaaacaggcctgagcgatgggcatcacaccctctgcctacccacgtgcctgcttacctgccagataaccaagtgagatgtctgcgagtggctagttttcacattcttactagtgtttggctcacctttgggcaaaggccccctctaggccttgccccacctccatcaaacgcagacactgtagtcagacctcagcaatataggaggcaataatcttttaacagtgttttgcaaacaaacaaaa

SEQ ID NO: 334410 - DNA, 1203 bp, Homo sapiens
agcggacttttgggatgtgatgcccaaccgccatctctcctggcatgggggtccctcagctctcccttcctccccacaggtaatggacagctcaatgccgctgattggagagcatgtggaagaggacagacagctgatggccgaccttgttgtctccaaaatgagccagctcccgatgccaggaggcacagcgccctcccccctcagaccttgggctccacagattaaatcagcgaaatccccagggcaagcccagctggggcctcagctaggccagccccagccacgcccacctccgcaaggaggccctcgccaagctcagtctcctcagccccagagatctggaagcccctcccaacagaggctctccccacaaggccagcagcccctgagcccccagtccggatctccacagcagcaaaggtcaccaggctctccgcagctatcccgggcatccagtggcagctccccaaaccaggcctccaagccaggtgccaccctcgcctcacagccccggccccctgtgcagggccgtagtacctcccagcagggtgaagagtccaagaagccagcaccaccccatccgcatctcaacaaatctcagtccctgactaacagcctcagcacatccgacacctcccagcgtgggaccccaagtgaagacgaggccaaggctgaaaccatccgcaacctgaggaagtcttttgccagcctgttctctgactaacgccatccaggctgggaggggaagagtgctctgctacactcgtccccctcctgcctcatcttccttctcagccttggttcctgatgggaacagaatggagggcctgagaacatactttctaaatgcctttgacccaggaaccgattatctatatttgttcccattttccttcaccgtgacattccagcattgtctgactgtgaggtgggcctttgagagcctccaggttcctcaaaacaggcctgagcgatgggcatcacaccctctgcctacccacgtgcctgcttacctgccagataaccaagtgagatgtctgcgagtggctagttttcacattcttactagtgtttggctcacctttgggcaaaggccccctctaggccttgccccacctccatcaaacgcagacactgtagtcagacctcagcaatataggaggcaataatcttttaacagtgttttgcaaacaaacaaaa

SEQ ID NO: 334411 - DNA, 2460 bp, Homo sapiens
tcccgggacccggagcggatcgactggcgggcgccgcgccgaggcaccaccgggcgccgagttcctggcggctcgcacgcaggtaaataaaggcagctaaagctgactgctggttgcgcaaaatccccctggctcttctggctaaagtcctaccactccctgtacctggcagcagcctgtcttctgggcctcacctacacacgtctgggtaggagccagtcatctccatccatccacagccatgaatttcctccggcgacgtctctctgacagcagcttcatggccaacctgcctaatggctatatgacggacctgcaacgcccagatagctccaccagctcacctgcttcccccgccatggagaggaggcacccccagcccctggctgcctccttctcctctccaggatccagcctttttagctccctctccagtgccatgaagcaggcccctcaggccacctcaggactgatggagcctccaggtccctccacgcccattgttcaaagacccaggatcctgttggtgatcgatgatgcccatacagactggtcgaagtatttccatgggaagaaggtgaatggagagattgagatccgagtggagcaggctgaattctcagagttgaacctagctgcctatgtgaccgggggctgcatggtggacatgcaggtcgtgagaaatgggaccaaagtggtgagcagatccttcaagccagacttcatcctggtccgccagcatgcctacagcatggccctgggggaagactaccgcagcctggtcatcggcctgcagtatggagggctgcctgctgtcaactctctctactccgtctacaacttctgcagcaagccctgggtgttctctcagctcattaagatcttccattccctgggtcctgagaagttcccgcttgtggagcaaacatttttccccaaccataagccaatggtcacagccccacacttcccggtggtagtcaagctgggacatgcccacgctggaatgggaaagatcaaagtggaaaaccagcttgacttccaggacatcaccagcgtggtcgccatggccaaaacatacgccaccaccgaggcgttcatcgactccaagtacgacatccgcatccagaaaattggatccaactacaaggcttacatgagaacctccatctctgggaactggaaggccaacacaggctctgccatgctggagcaggtggccatgacagagaggtacaggctgtgggtggacagctgctcggaaatgtttggcggcctggacatctgtgccgtcaaggctgtccacagcaaggatggcagagattacatcatcgaggtaatggacagctcaatgccgctgattggagagcatgtggaagaggacagacagctgatggccgaccttgttgtctccaaaatgagccagctcccgatgccaggaggcacagcgccctcccccctcagaccttgggctccacagattaaatcagcgaaatccccagggcaagcccagctggggcctcagctaggccagccccagccacgcccacctccgcaaggaggccctcgccaagctcagtctcctcagccccagagatctggaagcccctcccaacagaggctctccccacaaggccagcagcccctgagcccccagtccggatctccacagcagcaaaggtcaccaggctctccgcagctatcccgggcatccagtggcagctccccaaaccaggcctccaagccaggtgccaccctcgcctcacagccccggccccctgtgcagggccgtagtacctcccagcagggtgaagagtccaagaagccagcaccaccccatccgcatctcaacaaatctcagtccctgactaacagcctcagcacatccgacacctcccagcgtgggaccccaagtgaagacgaggccaaggctgaaaccatccgcaacctgaggaagtcttttgccagcctgttctctgactaacgccatccaggctgggaggggaagagtgctctgctacactcgtccccctcctgcctcatcttccttctcagccttggttcctgatgggaacagaatggagggcctgagaacatactttctaaatgcctttgacccaggaaccgattatctatatttgttcccattttccttcaccgtgacattccagcattgtctgactgtgaggtgggcctttgagagcctccaggttcctcaaaacaggcctgagcgatgggcatcacaccctctgcctacccacgtgcctgcttacctgccagataaccaagtgagatgtctgcgagtggctagttttcacattcttactagtgtttggctcacctttgggcaaaggccccctctaggccttgccccacctccatcaaacgcagacactgtagtcagacctcagcaatataggaggcaataatcttttaacagtgttttgcaaacaaacaaaa

SEQ ID NO: 334412 - DNA, 1224 bp, Homo sapiens
tcccgggacccggagcggatcgactggcgggcgccgcgccgaggcaccaccgggcgccgagttcctggcggctcgcacgcaggtaaataaaggcagctaaagctgactgctggttgcgcaaaatccccctggctcttctggctaaagtcctaccactccctgtacctggcagcagcctgtcttctgggcctcacctacacacgtctgggtaggagccagtcatctccatccatccacagccatgaatttcctccggcgacgtctctctgacagcagcttcatggccaacctgcctaatggctatatgacggacctgcaacgcccagatagctccaccagctcacctgcttcccccgccatggagaggaggcacccccagcccctggctgcctccttctcctctccaggatccagcctttttagctccctctccagtgccatgaagcaggcccctcaggccacctcaggactgatggagcctccaggtccctccacgcccattgttcaaagacccaggatcctgttggtgatcgatgatgcccatacagactggtcgaagtatttccatgggaagaaggtgaatggagagattgagatccgagtggagcaggctgaattctcagagttgaacctagctgcctatgtgaccgggggctgcatggtggacatgcaggtcgtgagaaatgggaccaaagtggtgagcagatccttcaagccagacttcatcctggtccgccagcatgcctacagcatggccctgggggaagactaccgcagcctggtcatcggcctgcagtatggagggctgcctgctgtcaactctctctactccgtctacaacttctgcagcaagccctgggtgttctctcagctcattaagatcttccattccctgggtcctgagaagttcccgcttgtggagcaaacatttttccccaaccataagccaatggtctcaccctccttaccctagtcctggccctgatcatccagctctgttcccctccagggtacatgctcttaaccaccccactatgtggcctctcccagtcaagggcaccatcaggattcaaagagctttgaaggaggtgacttatactgggagctggacgagaaggaagattgcaaagaggctcccaggggatggctctggcaaaatacaaagaaaaaagtttataaagcgtttaaataaacctgtgaaagacaagaaagatagtaagagaa

SEQ ID NO: 334413 - DNA, 720 bp, Homo sapiens
agcggacttttgggatgtgatgcccaaccgccatctctcctggcatgggggtccctcagctctcccttcctccccacaggtaatggacagctcaatgccgctgattggagagcatgtggaagaggacagacagctgatggccgaccttgttgtctccaaaatgagccagctcccgatgccaggaggcacagcgccctcccccctcagaccttgggaggccctcgccaagctcagtctcctcagccccagagatctggaagcccctcccaacagaggctctccccacaaggccagcagcccctgagcccccagtccggatctccacagcagcaaaggtcaccaggctctccgcagctatcccgggcatccagtggcagctccccaaaccaggcctccaagccaggtgccaccctcgcctcacagccccggccccctgtgcagggccgtagtacctcccagcagggtgaagagtccaagaagccagcaccaccccatccgcatctcaagtctgttgcctcccctcctatgactgagcctcctgaggcagggcctgaatcatattcgtcttacacccctgtcccctagcacaggggaagtgctcagcaagcagttgctacaggctggcatttaggaagcactcagaatggcatctgccattcaaaaagatggcactaaaagaattccaaaagcgggtgggggacagaattagccataaagaca

SEQ ID NO: 334414 - DNA, 1266 bp, Homo sapiens
ctaaacaggtgtctgtggagggcacacctgcttagcaggacacggggcccattcctaaccttgggggctcccagtctggtggtggagacatagtaagcaaggggtgacagtgccgtggataagctgtcccgtgtgaaaccaggtaatggacagctcaatgccgctgattggagagcatgtggaagaggacagacagctgatggccgaccttgttgtctccaaaatgagccagctcccgatgccaggaggcacagcgccctcccccctcagaccttgggctccacagattaaatcagcgaaatccccagggcaagcccagctggggcctcagctaggccagccccagccacgcccacctccgcaaggaggccctcgccaagctcagtctcctcagccccagagatctggaagcccctcccaacagaggctctccccacaaggccagcagcccctgagcccccagtccggatctccacagcagcaaaggtcaccaggctctccgcagctatcccgggcatccagtggcagctccccaaaccaggcctccaagccaggtgccaccctcgcctcacagccccggccccctgtgcagggccgtagtacctcccagcagggtgaagagtccaagaagccagcaccaccccatccgcatctcaacaaatctcagtccctgactaacagcctcagcacatccgacacctcccagcgtgggaccccaagtgaagacgaggccaaggctgaaaccatccgcaacctgaggaagtcttttgccagcctgttctctgactaacgccatccaggctgggaggggaagagtgctctgctacactcgtccccctcctgcctcatcttccttctcagccttggttcctgatgggaacagaatggagggcctgagaacatactttctaaatgcctttgacccaggaaccgattatctatatttgttcccattttccttcaccgtgacattccagcattgtctgactgtgaggtgggcctttgagagcctccaggttcctcaaaacaggcctgagcgatgggcatcacaccctctgcctacccacgtgcctgcttacctgccagataaccaagtgagatgtctgcgagtggctagttttcacattcttactagtgtttggctcacctttgggcaaaggccccctctaggccttgccccacctccatcaaacgcagacactgtagtcagacctcagcaatataggaggcaataatcttttaacagtgttttgcaaacaaacaaaa

SEQ ID NO: 334415 - DNA, 1292 bp, Homo sapiens
tcccgggacccggagcggatcgactggcgggcgccgcgccgaggcaccaccgggcgccgagttcctggcggctcgcacgcaggtaaataaaggcagctaaagctgactgctggttgcgcaaaatccccctggctcttctggctaaagtcctaccactccctgtacctggcagcagcctgtcttctgggcctcacctacacacgtctgggtaggagccagtcatctccatccatccacagccatgaatttcctccggcgacgtctctctgacagcagcttcatggccaacctgcctaatggctatatgacggacctgcaacgcccagatagctccaccagctcacctgcttcccccgccatggagaggaggcacccccagcccctggctgcctccttctcctctccaggatccagcctttttagctccctctccagtgccatgaagcaggcccctcaggccacctcaggactgatggagcctccaggtccctccacgcccattgttcaaagacccaggatcctgttggtgatcgatgatgcccatacagactggtcgaagtatttccatgggaagaaggtgaatggagagattgagatccgagtggagcaggctgaattctcagagttgaacctagctgcctatgtgaccgggggctgcatggtggacatgcaggtcgtgagaaatgggaccaaagtggtgagcagatccttcaagccagacttcatcctggtccgccagcatgcctacagcatggccctgggggaagactaccgcagcctggtcatcggcctgcagtatggagggctgcctgctgtcaactctctctactccgtctacaacttctgcagcaagccctgggtgttctctcagctcattaagatcttccattccctgggtcctgagaagttcccgcttgtggagcaaacatttttccccaaccataagccaatggtgagtgcccttttttactctgtttctttgcatgatgcggaatgaatacagatgacttgtcctcggtctctttggatggaggaggtggactctaggggttgtacactgaccacgcagactctaaggcggagtcacagtgtcctgtgggagtgcctggatttcctaagggaagtcgtctctccaggtgaaattcaggcaatagggcaaataacaaaggtgaaccacattccttggaacttggagattttcagcaaatcaggggacacgttctgggggcatgttagaaccagaggctgattataaaggtaaaagatgttttcaaggtgggatgttgttttac

SEQ ID NO: 334416 - DNA, 1240 bp, Homo sapiens
ggaagcagaggagcagcagggtcagggtgctgggttcctaaggtgcaaggatgcagaacagaactggcctcattctctgtgctcttgccctcctgatgggtttcctgatggtctgcctgggggccttcttcatttcctggggctccatattcgactgtcaggggagcctgattgcggcctatttgcttctgcctctggggtttgtgatccttctgagtggaattttctggagcaactatcgccaggtgactgaaagcaaaggagtgttgaggcacatgctccgacaacaccttgctcatggggccctgcccgtggccacagtagacaggccagacttttaccctccagcttatgaagagagccttgaggtggaaaagcagagctgtcctgcagagagagaggcctctggcattcctccacctctatatacagagacgggcctggaattccaggatggaaatgactcccacccagaggccccaccatcttatagagagtccatagccggcctggtggtgacagcaatctcagaggacgcccagaggcgaggccaagagtgctgaggcagagaaagctctccagcactcatgatgccaccactgtggggagcagctactgataataaaggcaaacgagggactgtgggaggaaaagccacaccagggaccccacaagagagcttggggaggggatgacagccctgaattccagacataactggccatgccagggcagggcaggccaggggccctggaagggtgtggccaacaccaagcagacatttcagaggattcacactaatcttaaccccggctggccttgggtccccaaaggtgtcactctgagagctctgcttacagagattctttctgctgtcactcaatttccctcccatcacctcaactccagccagggaggaatagatgctggttgtcaggacagccacatgccttcctgttctatatcacctagtaatctcaaagcgaaggtttgttgtttaatttattgattgttcagccttttgttttgttagcttgtttcctagttacctccagctgaccatactaccagagtgaggcagtacttcacatcctgggagatatgccctcggaacccatgaatgttattttgtattattttattttcatgatatgtattttttctatgtaaaaggaaaatgactgtaatatttgccttcaagatggttcaaacacaaaatattaaatgagctgtttcttaa

SEQ ID NO: 334417 - DNA, 604 bp, Homo sapiens
ggaagcagaggagcagcagggtcagggtgctgggttcctaaggtgcaaggatgcagaacagaactggcctcattctctgtgctcttgccctcctgatgggtttcctgatggtctgcctgggggccttcttcatttcctggggctccatattcgactgtcaggggagcctgattgcggcctatttgcttctgcctctggggtttgtgatccttctgagtggaattttctggagcaactatcgccaggtgactgaaagcaaaggagtgttgaggcacatgctccgacaacaccttgctcatggggccctgcccgtggccacagtagacagtgctgctcttctgaaaatcatgtgtaagcaattgctttaaaaagaaaaatgaagaacccttctgacaagaaacaaaagacctgaaaaaggaatttgatttcatgaatacaaacataatcatttccctttcatgtttggttgcaatcaaaagctatggagttcaacctcagaagcctcatgctggagatttccagagagatttgatatttttttccctaaaacttcacaattcatctatgtatacaaatatacacaaatacaaatgtaattttgaaa

SEQ ID NO: 334418 - DNA, 1083 bp, Homo sapiens
ggcatcagaaaaccattctggtgaggtccacacccataagtcaccatgtacaaggactgcatcgagtccactggagactattttcttctctgtgacgccgaggggccatggggcatcattctggagtccctggccatacttggcatcgtggtcacaattctgctactcttagcatttctcttcctcatgcgaaagatccaagactgcagccagtggaatgtcctccccacccagctcctcttcctcctgagtgtcctggggctcttcggactcgcttttgccttcatcatcgagctcaatcaacaaactgcccccgtacgctactttctctttggggttctctttgctctctgtttctcatgcctcttagctcatgcctccaatctagtgaagctggttcggggttgtgtctccttctcctggacgacaattctgtgcattgctattggttgcagtctgttgcaaatcattattgccactgagtatgtgactctcatcatgaccagaggtatgatgtttgtgaatatgacaccctgccagctcaatgtggactttgttgtactcctggtctatgtcctcttcctgatggccctcacattcttcgtctccaaagccaccttctgtggcccgtgtgagaactggaagcagcatggaaggctcatctttatcactgtgctcttctccatcatcatctgggtggtgtggatctccatgctcctgagaggcaacccgcagttccagcgacagccccagtgggacgacccggtcgtctgcattgctctggtcaccaacgcatgggttttcctgctgctgtacatcgtccctgagctctgcattctctacagatcgtgtagacaggagtgccctttacaaggcaatgcctgccccgtcacagcctaccaacacagcttccaagtggagaaccaggagctctccagagcccgagacagtgatggagctgaggaggatgtagcattaacttcatatggtactcccattcagccgcagactgttgatcccacacaagagtgtttcatcccacaggctaaactaagcccccagcaagatgcaggaggagtataa

SEQ ID NO: 334419 - DNA, 774 bp, Homo sapiens
agatggggtttcaccatgttggccaggctggtcttgaactcctgacttcaagtgatccacccaccttggcctcctaaagtgctaggattacaagcatgagccactgtaccctgccttgttttttgctttttgagacagagtctcactctgtcacccaggctggagtacagtggggcaatctcggctcaatgtaaactctgtctcctgggttcaagcgattctcctgcctcagcctcccgagtagctgagattacaagtgtgcaccaccacacccggctaatctttgtatttttagtagagatggggtttcaccatgttggctaggctggtcttgaactgctgacctcaagtgatcggcccgcctcagccttccaaagtgctgggataacaggagtgagccaccgcacccagccttcttgccattacttttaatagcaaaaagcacaattacttttgcaccaacctaagagatgcagagttgtcaatttgtctcatcctttttctgcagggcatcagaaaaccattctggtgaggtccacacccataagtcaccatgtacaaggactgcatcgagtccactggagactattttcttctctgtgacgccgaggggccatggggcatcattctggagtccctggccatacttggcatcgtggtcacaattctgctactcttagcatttctcttcctcatgcgaaagatccaagactgcagccagtggaatgtcctccccacccagctcctcttcctcctgagtgtcctggggctctt

SEQ ID NO: 334420 - DNA, 188 bp, Homo sapiens
tgaggcctctccccatcatgtcatgcacacatcatgaagccgcacattttcatgcctgctgcgaagtgcctactgtgcggggctgctgtgctacacactgctcacactccacccgggacacagtgcagccctgtatctccacactgcatgaatggaagaagcaatgatcggagaggtctcacagtaag

SEQ ID NO: 334421 - DNA, 383 bp, Homo sapiens
tccatcagttagattaacaagataagaagtgaagagaattgtaggcattcactcagaccattacttgcagaagtcagaggcaaactgagttattttccacgaagaagcagtgggtcacaaatatatatatgatacacatttcatgcaaagacagaaaagtgtgtgttttccatcaaccgcgaatacttttaatagtagaaaagtaagtgtattctagcttattgtttaaaaagatttgtattgttctcgtgttatatcaatggtgaatagcaattatcttttatattaaacttcaggagataagaatgtagtagtgctaaaaacaagaactattaaagcaaataattccaaactgactatggtgttttatgaaatatttacca

SEQ ID NO: 334422 - DNA, 175 bp, Homo sapiens
ttacccactgttgatgtcatcagtcctgagacttttcccaaggatatcaccatcactcatatatccacccacatcgacctcagaagacatgtccaggtcactgcttgctttctcactcatgtcaatctgtgacatgtttcccagcctagagacagcagctcgacggagaggcgtg

SEQ ID NO: 334423 - DNA, 1092 bp, Homo sapiens
caattatttagttggtttgggtatcttaatatcaaacggttagactttcaagagaaaaagaggacaatttttaatgacagcaaaatcaagtcatcaaaagtacataatgatcaaatgaaactgtttacaaatataacttcatagtaaaactgacatactgaagggagaaattgataaccccaccatggtagttgaaaacgtcaacatttatctctcagtatttggtaaaataagtagacaaaaaaattagtaacaatatagaaaacttggacaattcttttaatcagctccacctactttgtatgtgtacatgtgtatttttttttttgagatagaatctcactccattgtccaggtgggagtgcactggcaccatcatagctcactgtaacctcaaactcctgggctcaagtgattgtcctgccttgcctcccaagtagctaaaactacaggtgcagaggaccgcaactggtttattttttaaacttttggtagagatggggtctcactgtcttgcccaggctggtctcaaacccctggcctcaagcaatcctcctgcttcaacctccgaaagtgcctagttgttatttataatacagtaaatgtttgtattagaaatggtgaatggcttaaaatcagtgatattgcttctttattagataaggatagcaaaatgtacctagagtaagcagaagaaataatagagtggatatcagtgctatagagtatgaacaaataaattcataaagttggtgaaaccaacagttggttctctgaaaatagtaacaataaaattaataaattgtaactagggtggtcagaaaaaaatgtggaaacacaaataactaataatgagaatgaaagaggtggcattactactaattccacagacattaaaaggataataagataatattattaaaaatcataaaacatacaaaacattaaaaaaaattagccgggtgtgatgggacatccctatagtcctagctactcaggaggctgaggcaggaggataccttgagtgacctacgatcgtgccactgcactccagcctgggtggcagagaaggtgcctgtctcttaaaaagaa

SEQ ID NO: 334424 - DNA, 1038 bp, Homo sapiens
caattatttagttggtttgggtatcttaatatcaaacggttagactttcaagagaaaaagaggacaatttttaatgacagcaaaatcaagtcatcaaaagtacataatgatcaaatgaaactgtttacaaatataacttcatagtaaaactgacatactgaagggagaaattgataaccccaccatggtagttgaaaacgtcaacatttatctctcagtatttggtaaaataagtagacaaaaaaattagtaacaatatagtatttttttttttgagatagaatctcactccattgtccaggtgggagtgcactggcaccatcatagctcactgtaacctcaaactcctgggctcaagtgattgtcctgccttgcctcccaagtagctaaaactacaggtgcagaggaccgcaactggtttattttttaaacttttggtagagatggggtctcactgtcttgcccaggctggtctcaaacccctggcctcaagcaatcctcctgcttcaacctccgaaagtgcctagttgttatttataatacagtaaatgtttgtattagaaatggtgaatggcttaaaatcagtgatattgcttctttattagataaggatagcaaaatgtacctagagtaagcagaagaaataatagagtggatatcagtgctatagagtatgaacaaataaattcataaagttggtgaaaccaacagttggttctctgaaaatagtaacaataaaattaataaattgtaactagggtggtcagaaaaaaatgtggaaacacaaataactaataatgagaatgaaagaggtggcattactactaattccacagacattaaaaggataataagataatattattaaaaatcataaaacatacaaaacattaaaaaaaattagccgggtgtgatgggacatccctatagtcctagctactcaggaggctgaggcaggaggataccttgagtgacctacgatcgtgccactgcactccagcctgggtggcagagaaggtgcctgtctcttaaaaagaa

SEQ ID NO: 334425 - DNA, 448 bp, Homo sapiens
aaacagacgaacaacaacaaaaaaaccccaataaaaacacaaaacactgacaataccaaaagctagctagaatgtggagcatcaggaactgtaatccactgaacaatggtatagccactttggaagatagtttggcagtttcttacaatgttacatatgggcttaccatatgatccagcaatcatgcacctaggtatttactcaaaaacttatgtacacacaaaacctgtatacaaatgctgatagcagctttattcataatggccaaacacaggaaaatgtccttcaattggcaagatttgccttcataagtgagtgaataaacatactgtggtacatccagagtgaaatataattcagtgatgaaaagaaatgatctataaggtcacaaaaagacatagaggaatcttacatggatattgtaaagtaaaagaacagtctgaaaagg

SEQ ID NO: 334426 - DNA, 351 bp, Homo sapiens
ccaggtatgaatgccatagtttgtcattcttttaattttttttctatggtctttgttatttagagtagttttaggttcacagcaaaattgaacagaaagtacaaagttcccatacattctctctcaacacacacagccctccccacccctaacatcccacatcagtagggaacatttgttagaatcaatgaaccaacactgatgcatcattatcacccaaagtccatagtacacatacgtatgtattagcatacataggttcactcttgatgtgctttctcttgagttgtgacaaatgtctaatgacatgtatccacacagaatagtttctgctgccctaaaaatcctctg

SEQ ID NO: 334427 - DNA, 283 bp, Homo sapiens
gctggtctcaaacttctgggcagtctttccacctcagccttgcagagtggtacgattacaggcatgagccactgtgctcagccccaaatggaatattttagagggtatttacaacaacagcattagctaccagtccctttccattcacttttgtaacttctatcttacaagacagattgttcttttttttttgagacagtcttactctgccacccaggctggagtgcagtgtcgtgatcttggctcactgcagcctctgcctcgagggttcaagggattctca

SEQ ID NO: 334428 - DNA, 302 bp, Homo sapiens
tctttgcttacaatgcacataattcagccgcactggtcttttcgatttcccagttctggctgcctcttatcttaggatctttgctgtcacttccgttaagaatgcgctctcccaccttcattctccacccgttaacctctcttatgaaatcctcctgagtagtcacgatttccttcacaagcacttaccacatctggaatgacacagttctgactgattgttaaagaccggaagctccatgtgagcacagacagcatcttttctgctcatcaccgcatatacttgagcaaagaccccaaaag

SEQ ID NO: 334429 - DNA, 2137 bp, Homo sapiens
ggatttttaaaaatgagtgacaccacatggttctcttcaaagatgtaaactgctagggtgtttggatgcaagctgaaatcacctttaagaagcccatgcctaccaaggtggttttcatgagcctatgcaaaagtttctgggactgtgggcttgtagccctggatgacattacaatacaattgggaagctgctcatcttcagagaaacttccacctccacctggagagtgtactttcgagcaagatgaatgtacatttactcaggagaaaagaaaccggagcagctggcacaggaggaggggagaaactcccacttcctacacaggaccaaagggagatcacactactggggtaggctactacatgtacattgaggcctcccatatggtgtatggacaaaaagcacgcctcttgtccaggcctctgcgaggagtctctggaaaacactgcttgacctttttctaccacatgtatggagggggcactggcctgctgagtgtttatctgaaaaaggaagaagacagtgaagagtccctcttatggaggagaagaggtgaacagagcatttcctggctacgagcactgattgaatacagctgtgagaggcaacaccagataatttttgaagccattcgaggagtatcaataagaagtgatattgccattgatgatgttaaatttcaggcaggaccctgtggagaaatggaagatacaactcaacaatcatcaggatattctgaggacttaaatgaaattgagtattaagaaatgatctgcattggatttactagacgaaaaccatacctctcttcaatcaaaatgaaaacaaagcaaatgaatactggacagtcttaacaattttataagttataaaatgactttagagcaccctccttcattacttttgcaaaaacatactgactcagggctctttttttctttttgcatatgacaactgttactagaaatacaggctactggttttgcatagatcattcatcttaattttggtaccagttaaaaatacaaatgtactatattgtagtcattttaaagtacacaaagggcacaatcaaaatgagatgcactcatttaaatctgcattcagtgaatgtattgggagaaaaataggtcttgcaggtttccttttgaattttaagtatcataaatattttttaagtaaataatacggggtgtcagtaatatctgcagaatgaatgcagtctttcatgctaatgagttagtctggaaaaataaagtcttattttctatgttttattcatagaaatggagtattaatttttaatattttcaccatatgtgataacaaaggatctttcatgaatgtccaagggtaagtcagtattaattaatgctgtattacaaggcaatgctaccttctttattccccctttgaactacctttgaagtcactatgagcacatggatagaaatttaacttttttttgtaaagcaagcttaaaatgtttatgtatacatacccagcaacttttataaatgtgttaaacaattttactgatttttataataaatattttggtaagattttgaataatatgaattcaggcagatatactaaactgcttttatttacttgtttagaaaattgtatatatatgtttgtgtatcctaacagctgctatgaaattataaaattacctaataaaaataatttgaaaatcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaagaaaaaaagacgaacaaaaaaaaagacaaaacaaaagagagggggagagaagagagcatactactcaggagggcggcaggcggcagaaacacgcgagagataacatgagcataaatagtatgagagggaggaggcaatagtaggctggagagataacaaagtaagggagaagaatgagaaacacagaaatcataccagaaggaactagatactgaagatgggaaagagggtagaagcactgaaactatttgtgtgtaggaatagggagatagagagcaccatcaaggatagagatgggggggagagaaaaaaaaaaagtaag

SEQ ID NO: 334430 - DNA, 2461 bp, Homo sapiens
gtcgaccctttcactgactgagtcagcctacccaggtatctaggataatttcccttatgtaaagtcaaatgataggccagatgtggtggttcatgcctgtaatcctagcactttcagaggctgaggcaggagaatcacttgaacccagtaggcagaggttgcagtgagccaagatcgtaccactacactccagccttggcgacagagcgagactccatctcaaaaattaacaataataataaaagtaattccagggttttatgcagatggtaaccattcttcttcctactgtgttctgttgttcatacggacgctgaagagctgcttgtagtttgcctatgctcgcctgctgtgctaagtgaatcccaggttgttaggagtttccagttttcagttaacagaattcatagctttatttttatgaatttcaggtggttttcatgagcctatgcaaaagtttctgggactgtgggcttgtagccctggatgacattacaatacaattgggaagctgctcatcttcagagaaacttccacctccacctggagagtgtactttcgagcaagatgaatgtacatttactcaggagaaaagaaaccggagcagctggcacaggaggaggggagaaactcccacttcctacacaggaccaaagggagatcacactactggggtaggctactacatgtacattgaggcctcccatatggtgtatggacaaaaagcacgcctcttgtccaggcctctgcgaggagtctctggaaaacactgcttgacctttttctaccacatgtatggagggggcactggcctgctgagtgtttatctgaaaaaggaagaagacagtgaagagtccctcttatggaggagaagaggtgaacagagcatttcctggctacgagcactgattgaatacagctgtgagaggcaacaccagataatttttgaagccattcgaggagtatcaataagaagtgatattgccattgatgatgttaaatttcaggcaggaccctgtggagaaatggaagatacaactcaacaatcatcaggatattctgaggacttaaatgaaattgagtattaagaaatgatctgcattggatttactagacgaaaaccatacctctcttcaatcaaaatgaaaacaaagcaaatgaatactggacagtcttaacaattttataagttataaaatgactttagagcaccctccttcattacttttgcaaaaacatactgactcagggctctttttttctttttgcatatgacaactgttactagaaatacaggctactggttttgcatagatcattcatcttaattttggtaccagttaaaaatacaaatgtactatattgtagtcattttaaagtacacaaagggcacaatcaaaatgagatgcactcatttaaatctgcattcagtgaatgtattgggagaaaaataggtcttgcaggtttccttttgaattttaagtatcataaatattttttaagtaaataatacggggtgtcagtaatatctgcagaatgaatgcagtctttcatgctaatgagttagtctggaaaaataaagtcttattttctatgttttattcatagaaatggagtattaatttttaatattttcaccatatgtgataacaaaggatctttcatgaatgtccaagggtaagtcagtattaattaatgctgtattacaaggcaatgctaccttctttattccccctttgaactacctttgaagtcactatgagcacatggatagaaatttaacttttttttgtaaagcaagcttaaaatgtttatgtatacatacccagcaacttttataaatgtgttaaacaattttactgatttttataataaatattttggtaagattttgaataatatgaattcaggcagatatactaaactgcttttatttacttgtttagaaaattgtatatatatgtttgtgtatcctaacagctgctatgaaattataaaattacctaataaaaataatttgaaaatcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaagaaaaaaagacgaacaaaaaaaaagacaaaacaaaagagagggggagagaagagagcatactactcaggagggcggcaggcggcagaaacacgcgagagataacatgagcataaatagtatgagagggaggaggcaatagtaggctggagagataacaaagtaagggagaagaatgagaaacacagaaatcataccagaaggaactagatactgaagatgggaaagagggtagaagcactgaaactatttgtgtgtaggaatagggagatagagagcaccatcaaggatagagatgggggggagagaaaaaaaaaaagtaag

SEQ ID NO: 334431 - DNA, 844 bp, Homo sapiens
gtcgaccctttcactgactgagtcagcctacccaggtatctaggataatttcccttatgtaaagtcaaatgataggccagatgtggtggttcatgcctgtaatcctagcactttcagaggctgaggcaggagaatcacttgaacccagtaggcagaggttgcagtgagccaagatcgtaccactacactccagccttggcgacagagcgagactccatctcaaaaattaacaataataataaaagtaattccagggttttatgcagatggtaaccattcttcttcctactgtgttctgttgttcatacggacgctgaagagctgcttgtagtttgcctatgctcgcctgctgtgctaagtgaatcccaggttgttaggagtttccagttttcagttaacagaattcatagctttatttttatgaatttcaggtggttttcatgagcctatgcaaaagtttctgggactgtgggcttgtagccctggatgacattacaatacaattgggaagctgctcatcttcagagaaacttccacctccacctggagagtgtactttcgagcaagatgaatgtacatttactcaggagaaaagaaaccggagcagctggcacaggaggaggggagaaactcccacttcctacacaggaccaaagggagatcacactactggggtaggtgagttatgccacgtggtgctgtttcctaaggaaagcttctaaaatagcattctaggaatcgtttactgcattttgaaatgtgcaaaattatgtcttgtgtctataatgaaatgcacttgtgattctacacacacaggatgatttgatatgggcattgaatatct

SEQ ID NO: 334432 - DNA, 1704 bp, Homo sapiens
ggatttttaaaaatgagtgacaccacatggttctcttcaaagatgtaaactgctagggtgtttggatgcaagctgaaatcacctttaagaagcccatgcctaccaaggtggttttcatgagcctatgcaaaagtttctgggactgtgggcttgtagccctggatgacattacaatacaattgggaagctgctcatcttcagagaaacttccacctccacctggagagtgtactttcgagcaagatgaatgtacatttactcaggagaaaagaaaccggagcagctggcacaggaggaggggagaaactcccacttcctacacaggaccaaagggagatcacactactggggtaggctactacatgtacattgaggcctcccatatggtgtatggacaaaaagcacgcctcttgtccaggcctctgcgaggagtctctggaaaacactgcttgacctttttctaccacatgtatggagggggcactggcctgctgagtgtttatctgaaaaaggaagaagacagtgaagagtccctcttatggaggagaagaggtgaacagagcatttcctggctacgagcactgattgaatacagctgtgagaggcaacaccagataatttttgaagccattcgaggagtatcaataagaagtgatattgccattgatgatgttaaatttcaggcaggaccctgtggagaaatggaagatacaactcaacaatcatcaggatattctgaggacttaaatgaaattgagtattaagaaatgatctgcattggatttactagacgaaaaccatacctctcttcaatcaaaatgaaaacaaagcaaatgaatactggacagtcttaacaattttataagttataaaatgactttagagcaccctccttcattacttttgcaaaaacatactgactcagggctctttttttctttttgcatatgacaactgttactagaaatacaggctactggttttgcatagatcattcatcttaattttggtaccagttaaaaatacaaatgtactatattgtagtcattttaaagtacacaaagggcacaatcaaaatgagatgcactcatttaaatctgcattcagtgaatgtattgggagaaaaataggtcttgcaggtttccttttgaattttaagtatcataaatattttttaagtaaataatacggggtgtcagtaatatctgcagaatgaatgcagtctttcatgctaatgagttagtctggaaaaataaagtcttattttctatgttttattcatagaaatggagtattaatttttaatattttcaccatatgtgataacaaaggatctttcatgaatgtccaagggtaagtcagtattaattaatgctgtattacaaggcaatgctaccttctttattccccctttgaactacctttgaagtcactatgagcacatggatagaaatttaacttttttttgtaaagcaagcttaaaatgtttatgtatacatacccagcaacttttataaatgtgttaaacaattttactgatttttataataaatattttggtaagattttgaataatatgaattcaggcagatatactaaactgcttttatttacttgtttagaaaattgtatatatatgtttgtgtatcctaacagctgctatgaaattataaaattacctaataaaaataatttgaaaatctt

SEQ ID NO: 334433 - DNA, 2296 bp, Homo sapiens
ggtattacctgctagccaacacaaagttcacatctcagcctggctacattggaaggctctatgggccctccctaccaggaaacttgcagtattgtctgcgttttcattatgccatctatggatttttaaaaatgagtgacaccctagcagtttacatctttgaagagaaccatgtggttcaagagaagatctggtctgtgttggagtccccaaggggtgtttggatgcaagctgaaatcacctttaagaagcccatgcctaccaaggtggttttcatgagcctatgcaaaagtttctgggactgtgggcttgtagccctggatgacattacaatacaattgggaagctgctcatcttcagagaaacttccacctccacctggagagtgtactttcgagcaagatgaatgtacatttactcaggagaaaagaaaccggagcagctggcacaggaggaggggagaaactcccacttcctacacaggaccaaagggagatcacactactggggtaggctactacatgtacattgaggcctcccatatggtgtatggacaaaaagcacgcctcttgtccaggcctctgcgaggagtctctggaaaacactgcttgacctttttctaccacatgtatggagggggcactggcctgctgagtgtttatctgaaaaaggaagaagacagtgaagagtccctcttatggaggagaagaggtgaacagagcatttcctggctacgagcactgattgaatacagctgtgagaggcaacaccagataatttttgaagccattcgaggagtatcaataagaagtgatattgccattgatgatgttaaatttcaggcaggaccctgtggagaaatggaagatacaactcaacaatcatcaggatattctgaggacttaaatgaaattgagtattaagaaatgatctgcattggatttactagacgaaaaccatacctctcttcaatcaaaatgaaaacaaagcaaatgaatactggacagtcttaacaattttataagttataaaatgactttagagcaccctccttcattacttttgcaaaaacatactgactcagggctctttttttctttttgcatatgacaactgttactagaaatacaggctactggttttgcatagatcattcatcttaattttggtaccagttaaaaatacaaatgtactatattgtagtcattttaaagtacacaaagggcacaatcaaaatgagatgcactcatttaaatctgcattcagtgaatgtattgggagaaaaataggtcttgcaggtttccttttgaattttaagtatcataaatattttttaagtaaataatacggggtgtcagtaatatctgcagaatgaatgcagtctttcatgctaatgagttagtctggaaaaataaagtcttattttctatgttttattcatagaaatggagtattaatttttaatattttcaccatatgtgataacaaaggatctttcatgaatgtccaagggtaagtcagtattaattaatgctgtattacaaggcaatgctaccttctttattccccctttgaactacctttgaagtcactatgagcacatggatagaaatttaacttttttttgtaaagcaagcttaaaatgtttatgtatacatacccagcaacttttataaatgtgttaaacaattttactgatttttataataaatattttggtaagattttgaataatatgaattcaggcagatatactaaactgcttttatttacttgtttagaaaattgtatatatatgtttgtgtatcctaacagctgctatgaaattataaaattacctaataaaaataatttgaaaatcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaagaaaaaaagacgaacaaaaaaaaagacaaaacaaaagagagggggagagaagagagcatactactcaggagggcggcaggcggcagaaacacgcgagagataacatgagcataaatagtatgagagggaggaggcaatagtaggctggagagataacaaagtaagggagaagaatgagaaacacagaaatcataccagaaggaactagatactgaagatgggaaagagggtagaagcactgaaactatttgtgtgtaggaatagggagatagagagcaccatcaaggatagagatgggggggagagaaaaaaaaaaagtaag

SEQ ID NO: 334434 - DNA, 401 bp, Homo sapiens
ctgcctttccaacagcatctagcgtcaaatatacaggaggctgagctgttattcctgtttttgttcaatccatctgagttgcaagtgaaaataatatttatactgcccaccattcatggactaaagaggaacggggaagagctgtcgcatctgtagagttgctactgaagaatggcaagtcagaaaaatggtaacattcacacgcacacttgcacacacacacactcaccatgcagttggcctgggagcacacacacacactcaccatgcagttggcctgggagggagtgcggactgagaggtgaaggatgcggggtggtcgcagggagttgatggaagtcagaaagggctccacagagggcatggtggcacgtgcctgtaattccagctacttgggaagc

SEQ ID NO: 334435 - DNA, 278 bp, Homo sapiens
ccgccaccgaggacaccttgtgtggccccagtcctggcactggcctggctcccagtgagggtggccagaccctgggcagggcttcatcggctgagctgcctcctggctggtgggcctcagcctgcttctgagggaggagcagcccaggtgtccctcagcctgtttcagctccagccgctccctcgtgttctgtctgcacttagtccccccacatgctgcccacctcacacacaccgctgccttcctggctgctggaagctgggtgagacagcctgccc

SEQ ID NO: 334436 - DNA, 404 bp, Homo sapiens
taggggaagaataaggtaaagactggattctttataaacagaatacaaattccctggatttctaatactttaaaatattttagccaagtactgggtacaaattggcacccaataactaacaccagattaggccgggcatggtggctcccacctgtaatcccagcactttaggaggccaaggcaggtggataacttgtgttcaggattttgaaactagcctggccaatatggtgaaatctcgtctccactaaaaattcaaaaattagccaggcatgatagaacacacctgcagtcccagctacttgagaggctgaggcaggagaatcacttgaacccgggaggcagaggttgcagtgagccgatattgtgccactgcactccaacctgggcgacagagcaagact

SEQ ID NO: 334437 - DNA, 264 bp, Homo sapiens
tcttcaaaaaatagtgtgacacactgtggaagtcagatcaaaggcctcctaaggaaccatgcctgcgggtactcacacccttgtacagagccctctccttgatcctgaacctctcaggttcacaaaagcaactctcagacttgcttttgtccaacagaatgcgtggatgtgatggtgctgacttcaagaccagctcacgagaagccttgcagcttggcccaggtctctaaaatgcactatctgggggacactagctaatacgta

SEQ ID NO: 334438 - DNA, 496 bp, Homo sapiens
gacaggaacagaatggttttcgagaaaaccacatagaggtaaaagcgggatcatgagattggaggaaggaaataaaaaaccctggaaaagataggagggagaaagagaacagagccttgggatttgccatatttagggagagaagcaacggactgaagacagagaaaggcccgaaagtagtgaataaaaaatagtaaaaggttcattcaatccagggtcacatcagaaaagaaacaagatagtctgaatcagaggtgtagattagctgtgatgtccaatttaaacatacaacactaaattcattgatattaaaggaactcataacatgaaattacatagcaaatcaaactgcaatttctagaatgaactgcacttatcttctacttaattcttccattcagtattgactcaagatctatcaaggggaaacaaagacagttaaaagggggctatataccataacaaattctacttgacgtcgttattgtccgtcatt

SEQ ID NO: 334439 - DNA, 485 bp, Homo sapiens
ttatgttaagtaaaataagccaggcacagaaagataaatactgcatattctcactcatatgtgggagttaaaaaatgtggatctcatgaaggtagaaagtcgaatggtggtttccagaggctgggaagggaaggagtttggggaatgaagagaagtgggttaatggttataaacatacagctagagagaaggaaaaagttttagtattcaatagtacagtagggagactacagttaacaataattatatatttcaaaatggcttgaagtaaaaaattggaatgtttctaacacaaagaaaagataaatgttagaggtgatgaatatcccagttaccctgatttgatcattacacattgtatacgtgtatcaaaatatcacatataccccccaaatatgtacagctattatatatcaatttttgaaaagggagaaaagtagaacacctgataggcttggtgtgaagagaaattaagctaatatatg

SEQ ID NO: 334440 - DNA, 229 bp, Homo sapiens
cacctgcacaaaaggcagaatgtgaaccatctccacgttttacatgcactacctgggaaataataatatttggatagactgcattaaatagattatatgaaaattgactttatgggtttattttttaaaagctttttaaaatgtgattaccggtaaatctaagatttcttacatggcttctgtttgtggctaacattatacacctatcggacagcactggtgtgaaggg

SEQ ID NO: 334441 - DNA, 289 bp, Homo sapiens
caatatttagaccattcctccaggtatctcttggcctaatcccttctagtttaaagtacaggctttggattctcctggccttggacctaggcataacttcctgttgaatgctctttatcaccctccctatctcagtgattctatagtagaaacccatcttggcttcattcagcctttgaagcagccctttttatacaatgctcccaaaacagcttctctctttgggtattagggagtaatacccaaagtcatagtgacaaggcacatgaccccaattctggatgtgaga

SEQ ID NO: 334442 - DNA, 190 bp, Homo sapiens
tgtgccacccacttagagaggcctcccttgagcacactacctaaggagagcccctcccttttattctttatctcagtctcttgtttcctttatagcccatgcacatttaattttattaattttctgcatgtgtttagtttttagaattttaacagctttattgagatataattcacacaccatacagttt

SEQ ID NO: 334443 - DNA, 233 bp, Homo sapiens
agtgaaattcgggtataaggctaatgtgacctcatttaaaatcacaggctggagaggcccagggactttgggtatctatttacatagccaagataacatcagattcaaattttatttagtgctttttgtatctatgactgtcaaacattgtcacagtttaacagctacataatactccatcaaaaggatattatatgaagtgtggtggctcacacctgtaatccccacatttt

SEQ ID NO: 334444 - DNA, 539 bp, Homo sapiens
tgtcttatcccaagtacaggtatgatccaaagtagaagtaggaagctttccaagagctactgtgaagaagaatgtgtgtctgtactagcagttgatctctgcaacatgtattcatgttaaaattggggaagtcaaggatagagtcttggttgagaaactatttttctcctcttgtcagcctacttcaatgtatttatttctgtcttggatggttggagtggttcagctcttggtccctagagtttatgatttactattgtacagcctaatgttcttagaaaatggacatctacaaatgtctttgcagaagtactaaaggccaggaaataccttcgggagtatgtgttgtgcgttttcctctttctagaataattctttcctgcatttcattctctcgttttctacagactgcctttatctgatgtgagtagtttttaaaacatgtcatataatgctggtgccacaggtaaatgcttccaggaataccaaaatattctttaacaacgtggtgctatgttcaccacaggataattcgatgg

SEQ ID NO: 334445 - DNA, 342 bp, Homo sapiens
catggctacgaataaactatccaatctaaccacagaagctgagcatttggtttggggttaatccacatcacatgactcaccattgagaaagcggctctcaccatgcttaatgggcacagcacctctgcaaacaaatccttccctggctaatcattccctctgagaggtttcctcagtaaagagattagaactatctcttgtcatttccaacttttaaaaaattgacctttttggaaatctaccaccaccaactaattcttgacagacttgtagagaatgaccctcaaagaaatatcattcgagacacatattcaagcagactggccatggtggctcatgcct

SEQ ID NO: 334446 - DNA, 1561 bp, Homo sapiens
cggggagagagtatggactgaagcagctaaagaattgcagcatctaatggacaggaagaggggcagcgacagcgatggagcctgagaaggagggtgcagtgtccccaagccatgtggagaggttctgagattaaacagatcacacacatagcgcagagcatgctgcccagcagacatcctccaacctgctcaggggtggtgggcagggtcctgctcattccaggtgagaccgtgggctgagggctccaggtgctggcaggctctgagctgaggaaggcccgtacgttccacagagatctcatgccttgccctgtgctctgccagatgggcagaaggacttagccctataggaggcttgcccccgctccgtctggcctgttcagaaatggccaacagctcccgagttggtacagccccctcaggacctgccctgccgactgggtatgccactggccctcagcatcctgacctgcccccaccttgtcctgcaggaggtgtttcatagagaactaaggagcaactccatgaagacctggggcctgcgggcagctggctggatggccatgttcatgggcctcaaccttatgacacggatcctctacaccttggtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcaccccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaagtgccatgctttgccaccaccaccaagcacatctgtgatcctgaagggcggccgttagtcgttactgctgagtcctgggtcaccagcagacacactgggcatggacccctcaaagcaggcacacccaaaacacaagtctgtggctagaacctgatgtggtgtttaaaagagaagaaacactgaagatgtcctgaggagaaaagctggacatatactgggcttcacacttatcttatggcttggcacgctttggtgggataacgctggttttcttgaatgggttgatcgtggtatgggtcatcaggccgtgttctatggcgtgccccaacagttcgaaggtgatttgg

SEQ ID NO: 334447 - DNA, 348 bp, Homo sapiens
gccaccaccaccaagcacatctgtgatcctgaagggcggccgttagtcgttactgctgagtcctgggtcaccagcagacacactgggcatggacccctcaaagcaggcacacccaaaacacaagtctgtggctagaacctgatgtggtgtttaaaagagaagaaacactgaagatgtcctgaggagaaaagctggacatatactgggcttcacacttatcttatggcttggcagaatctttgtagtgtgtgggatctctgaaggccctatttaagtttttcttcgttactttgctgcttcatgtgtactttcctaccccaagaggaagttttctgaaataagattttt

SEQ ID NO: 334448 - DNA, 461 bp, Homo sapiens
tgaaaagaccctggcacccgcccgacacctgcgtgagccctaggatccaggtcctctctcacctctgacccagctccatgccagagcaggagccccggtcaattttggactctgcaccccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaagtgccatgctttgccaccaccaccaagcacatctgtgatcctgaagggcggccgtt

SEQ ID NO: 334449 - DNA, 1300 bp, Homo sapiens
tcattcgccgtggagactttttctaccacagcgaaaatcccaagtatccagaggtgggagacttgcgtgtctccttttcctatgctggactgagcggcgatgaccctgacctgggcccagctcacgtggtcactgtgattgcccggcagcggggtgaccagctagtcccattctccaccaagtctggggataccttactgctcctgcaccacggggacttctcagcagaggaggtgtttcatagagaactaaggagcaactccatgaagacctggggcctgcgggcagctggctggatggccatgttcatgggcctcaaccttatgacacggatcctctacaccttggtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcaccccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaagtgccatgctttgccaccaccaccaagcacatctgtgatcctgaagggcggccgttagtcgttactgctgagtcctgggtcaccagcagacacactgggcatggacccctcaaagcaggcacacccaaaacacaagtctgtggctagaacctgatgtggtgtttaaaagagaagaaacactgaagatgtcctgaggagaaaagctggacatatactgggcttcacacttatcttatggcttggcacgctttggtgggataacgctggttttcttgaatgggttgatcgtggtatgggtcatcaggccgtgttctatggcgtgccccaacagttcgaaggtgatttgg

SEQ ID NO: 334450 - DNA, 945 bp, Homo sapiens
tcattcgccgtggagactttttctaccacagcgaaaatcccaagtatccagaggtgggagacttgcgtgtctccttttcctatgctggactgagcggcgatgaccctgacctgggcccagctcacgtggtcactgtgattgcccggcagcggggtgaccagctagtcccattctccaccaagtctggggataccttactgctcctgcaccacggggacttctcagcagaggaggtgtttcatagagaactaaggagcaactccatgaagacctggggcctgcgggcagctggctggatggccatgttcatgggcctcaaccttatgacacggatcctctacaccttggtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcaccccctctcctcttcaggggccagacttggcagcatgtgcaccaggttggtgttcaccagctcatgtcttccccacatctcttcctacataaattcaccacacctacgtcacagacttctaagttcccaataagctccaccctttacagctacgatgtgtcaccccattctacacgatctcgtgcccttccgccattcgaaacggtaggccgtgggaagatcctcccttccttggtctacggggtcacttttgccacattgccccttgccggcgccgtccg

SEQ ID NO: 334451 - DNA, 222 bp, Homo sapiens
taggccatccagaaccgccgctaccatggtgccagctgcagtggggaggccagcggttgtggcaggagaggctgcaggggcagcaataacggtggtgggacccctgtcccccatgtctccaaggcaggcaactgagccacccccacctttgcatgaccaggcccataaaaaccccagagtcggccaaactggagcagaggatggagagacaaagggagatga

SEQ ID NO: 334452 - DNA, 431 bp, Homo sapiens
tgaccttctcctcatccaacctcaaacacatcaatcaaaattgatttctttctactatcatcattttgtcaatcatagggaaattgtttactgagatgaaacatacacaaaaaagttacgtttctatactttaataaaatatatgctttttttttttaaatccaagcaacactgtcaaaaggcaacaagtaaggaacagttcctgcccctgaaacatgagtatggcttctatcacagctggcccccagttttaaagtatacaactatgtagcaataagtgaccaaactttcagaaactagagaactggaagtcccacctaaaagtaacactttggttacagaaagagcctgctgcttgacttctaaagagggagggaaagagcagagagctgcctgacgtaattcctttctttgatacactactctaagct

SEQ ID NO: 334453 - DNA, 1015 bp, Homo sapiens
tcccagctacttgggaggctgaggcaggagaatggcctgaacctgggaggcggagcttgcagtgagctgagattgtgccactgcactccagcctgggcgaccgagggggactccctttccaaaaaaaaaaaaaagaaaagaaactacatctcaataataataataatttcaattataggttggaatttagagttcggttacatttactattggatgtgatcctttaaaaactcaagtagaggcttttccagcccattcataacattagaagttgggccgcctgtccagaggagaagctttcaagtaacactgaggctgattaaatacttttgtaaaataaagaataaatcacaagctcattggcacttgaaacttagcattgcagtgcagatgcagcagaaaatacttgtagcagttttctcagtgaaagagaaactagtcaagtagcttagagacattaaaacaagccacaagccctttgtgctagagatcatggttaaaagtcccctgaagatgtttttccacagtagaaattttgtttatatttatgtctgagagtgaaaaaagaaaatggaatcaataagtaaccatgttctgcaggagtttgaggttttgttgttacattgggatgtagtgagagaagaaaacgtattaattcttttctgttggtactttcttgaattacatttttaataaacttattgtgagattctgaacattgctcctgtgataatttctgaagtgctgatgagtagaaggttttctggttagacttctgttcagcacatctgagcttcgagattatttgtagttctcctggggcttttaaaatctctttgtatataatagataaatgctagtttcccatcagagaaggatttctttttccttttgtctgattgagcaagtgtcttgagattaagaaaatggatgtcagtgaattcaagtgttgtgctctgtcagtttgcagcaggtgaccagagagcaaaaacaccagagtagattctgtccctac

SEQ ID NO: 334454 - DNA, 631 bp, Homo sapiens
gagttattgttaaagtaaatgaattaactaacatttgttaaacacttaggaaagtacttgatccgtagtaaatatctaccatagtcaccagtatttatcatgagtgcctaatttaataataccctccaatatctaagaaaatctgagccttacatttttatgactccttgttctgctaaacaggtcagtgatttttaaatactctcctggatcttagaaacacccaaaacgtttaggttaaacaatcctaccttctccgtgaccctgtataacactatcagagtaagaattcagtaagcattagatttattcagtggcttagtttaccattagagtattctctttatatctcagtgtacttctatgtgtaatacacaaatgacatgttgtcagaagttatgtatgctgatcagagtcccaagctaagaacacagactaaataccatgtaactttcagcttgatttgaaataaacaagtatgaaagttacctagattgatttgacgtagagctgtgtagttgtcctttctatactctgagcctacaacatgccaatcacccaggaccctagagttttatgaaattagaaaaatgcctgaaatggtattttgcattgctctaagtctacagat

SEQ ID NO: 334455 - DNA, 267 bp, Homo sapiens
cactgggaaaattactggagcccacagctgcaacagcacatccccaagggaacatgctggagagtggcaacttctcctatctggttttaaacgtccccaactcctatacattcccttcccaggccccttccaggcagaagaggggactgcagtttccatactgctcacacaaaattaagcatctctttccagccagctcccaacagcctccctggtaagctggaaaatcagcttgggggatctgagttaagaagaacaacaagaaga

SEQ ID NO: 334456 - DNA, 385 bp, Homo sapiens
tcatctcatctcatgagcataaactcaaaagtttgatccaagggatcatgaatatcaaagactcttctattacctgggaaattccaaggatatagattctgtcttccaggaaccaggttcaaaggccagttaaattctttattatgcaacaaaagatttccctgaaaccagacttagaagtcttgaaagagatgggggattcaatttccacacaatccctgggctctagaacaaaggctgtcatcactgtcctcccctggtccaccattttgggttgtggtccctctctctccttgggaactttttcaagaatcagtattcagtcttccaggggctcttcattttacttctataccttgagatttatcacctgacggtgcctatt

SEQ ID NO: 334457 - DNA, 1351 bp, Homo sapiens
gcacaaaggctcattcaacaaacatttacagactgtctggcgttagtaacactgtagtgatcaagacatggcattgttgtccggaagcactagcagaggagttgccagattcaggctcgtgtcctgccctgccaccttcaagccatgtgacttggggcagagccacttcctctctatgggcctcacagattcatctgtaaaaaaggacccttgccccaatcccacacagaacctatgaagctaatggagtagaaaaggttttgcaaaccaaaatacataggataaatataggggcataagctggctatttagaatataataataataatgactttctgagtgcttgctatgtgcgaggcatcattttaaggatgttacatgcctcatctcgtttaattctcataacaccagttgggcattatttttaatattcctgatttacagatgagaaactggagggcaagagaaacttaagagttcagtctcccagcaagttagtggtagagctggaacttaactccatgttgtctgactccaagtccaacacactgtgcacgccactctgcccttgggaatctttcccttcagacagctctcttggccctaccttaaattctaattgctagatcttcctggaattgtcccctgacttactgcccccgatctggcgccagggcccagctgcctgcttctacctcctactttctgcaccatctcagggctcagccttgtctgtccaggggcccagaactgtgtccattctgcaggtcctcagtggcctgacctctgattctggtccaggcatggcactagatctggacttctgcctaccaagggacaggtgagaaaagaaactcgctgactttcccctgccgctcccacacctgcatcctgctgaggctgccagcagcctggttccttggtactgcaccacaaggcacgttcccagatgcacctgcagttccagaatgtggcccagcagcaggcttcccaagggcagcttccgggctcaatgcttcctttccccttaacagccactaacccctatgaatcctagcatcattctgggaagttctcccttaaagcctcttattctctcattgttctgtctttcccagggcaaagcctcacctccaccttcacactaaaaacagaggccaccactagggacatcagtcattcaaaacgaggcaccctctgctcctcccttcctctcctgtatccttggccagtcccgtcacctgcctccaggaggagtggttcctctccctgaccaaggcaaactcagccctctcttcctccacattcaggctctcctcacttgccacccgctctctgggccacctcggct

SEQ ID NO: 334458 - DNA, 293 bp, Homo sapiens
attatcttgatctgggtggtagttatggaggtgtgtaaaacacataaaaacacttcagtgtgtgtaagacttagctcaatttaaaaatgaagaacatggctgggcatggtggctcacgcctgtaatcccagcactttgggaggccaaggtgccggatcacctgaggtcaagagtttgagaccagcctgaccaacgtggagaaacctcatctctaataaaaatacaaaattagccaggcgtggtagcacatgcctgtaatcccagctattcaggaggctgaggcaggagaatca

SEQ ID NO: 334459 - DNA, 486 bp, Homo sapiens
aacaaaaaaaacccagggcaacatgccatgaaccacccgggtcccagagcacccagatgtacagctggctgctgtagccatgcccacaaaccgcccgggtccctggaatacccagggcaacatgccgtgaaccgcccgggtccccagagcacccagatgtacagctggctgctgtagccatgcccacgaaccacccgggtccctggaatacccggggcaacatgccgagaaccgcccggggttcctgacaccagcctcccaccgtgacaccagacgcaaaggctccatgtgcacgcagtgccagcctggtcccccaggaccttcaagacaagctcggcagcaactgcttcctttcagaccaacatgggaggactttctgcccatgttctgtggcaacgattacagcgcttccttctaaataacagatgaaaaaatcccacagagactatttaaaaatattcccctcctcagtttaaagacgttata

SEQ ID NO: 334460 - DNA, 450 bp, Homo sapiens
agtggctcacgcctgtaattccagcactttgggaagccaaggtgggcggatcacttgaggttaggagctggagaccagcctgaccaatgatggtgaaacctcatctctactaaaaatacaaaaattagccaggcgtggtggcgggcgcctgcaatcccagctacttgagaggctgaggcggagaatcgcttgaacccacgaggtggaggttgcagtgagccgagatcatgccactgtactccagcctgagtgacagagctagactctgtctcaaaaatgaatgaatgaatgaatgaatggagtgactgaatccataggacgaatacttttgtatttgtatacacagacagataggtaaaataactttgttattctctagcctcagataattataaataattttcctactgccactataaaaatgactggcagaacactcaaagataatgc

SEQ ID NO: 334461 - DNA, 480 bp, Homo sapiens
cccataaatatgcacaattattatgtcaactggaaacatgacttcatcttaaaaaggcacttgatgcttgtaaggccccctaataggtgtgaggagatccatgtgagtcagccacagccctacccctacagactcccaaatccaggttttatcatggcgagggtctttgtgtaggagaattaggtggaagtggaaccaagagtcagggaatttatatcctcacttcagctcctttataaggaccaatgccaagacacataattatatcttcatttttctaagaataagataggacttaattacctcaaaggaatgacatgaaaactaactaccaaagccctctaatgtctttaaaacttgctacattcacgcatggggttattactgtcactgtgtgtgcgtgcagacctggctgcaggaggggcacagagacaaaagcatggggctccccatcctgccgtctccccgcggacttacctg

SEQ ID NO: 334462 - DNA, 434 bp, Homo sapiens
gtggggaagagggatgactccaagtggcggtaatggtggtggccacgttgaagtctgcgtgataactatggtgctggagttgtttctagtgtcatgatttcaaacttgggttaagcagctttcttcaattttcactgactctccagtctctgccccctgcccacaaacttcctgcacccatccctgcccctttatcactcaccctacccccagtaagtacaaggagaagggctgagattagatctgtggggaggggcgctggggaggctgcagaccctgcctgggcccagacagggttcactagtgtgcctgtgtgtatttgcatgtgtgtgggcctgtgggtgtgtatgtgtaaaagccccaggcagccacagagccaggagtcgctaatagtttacattagaaaggtgaatgtcagccaaaaataaaattct

SEQ ID NO: 334463 - DNA, 1276 bp, Homo sapiens
cgcttgcgcagaagagactcccgggctcttaacgtcgggtatcaggagtttcttcccggagcaaggacccccaagacggaagaggatggccgcggcggctctgaggagattttggtcccggcgccgcgcagaggcgggcgacgcggtagtggcgaagccgggagtgtgggcgcggctggggtcctgggcccgcgcgctgctccgggactacgccgaggcctgcagggacgcttcggcggaggctagggcccggccggggcgcgccgctgtgtatgtgggtctgctgggcggcgcggcggcctgcttcacgctggcgcccagcgagggtgccttcgaggaggcgctgctggaggcgtcggggaccctcctgctgctggcgccggccacccgcaaccgcgagtccgaagccttcgtgcagaggctgctctggctgcggggccgtggccgcctgcgctacgtcaacctggggctctgctcgctggtgtacgaggcgcccttcgacgcccaggccagcctctaccaggcgcgttgccgctacctgcagccccgctggaccgacttccccggccgggtcctggacgtgggcttcgtgggtcgctggtgggtgctgggggcctggatgcgcgactgcgacatcaacgacgacgaattcctgcacctgccggcgcatttgcgggtggtcgggccccagcagctgcattccgagaccaacgagcggctcttcgatgagaagtacaagcctgtcgtgctcaccgacgatcaggtggaccaggcgctgtgggaggagcaggtcttgcagaaggagaagaaggacaggctcgccctgagccaggcccactcgctggtgcaggcggaggccccgagatgaaaccctgaggcccccgagtcctggcaaactgcttgcctggggtggtgcagttctgagagcagaacgacttgacacatgttcatcactggcagagctggtcatgagccttttatataagcctttttcatcgggcctcagaggccctccttaaggaggtaccacattggtcagctgacttgcaaactcttctaaggccacttagattttctttttcaagtttgggttgtggcctggcatggtgatgtctgtaatcccagcagtttgcaaactgaggcaagagaatcgcttgaggccaggagtttgaggccagctagagtgacatagcaagactccgatgctacaaaaaagaataataatagtaattaactaaataaaatttgagctgaaatgtttttattctatgaccta

SEQ ID NO: 334464 - DNA, 846 bp, Homo sapiens
ataaggctgtagaaaagacctaaaggattaagaaaatattatgccacattttctttggtggctttacagttttttttctttaaacctttatcttaattatgtctgaatttggggggcagtatgatgtgaggtaggtagctttatcatttggtacggtatagacagtagaggggtctctttactaaatttccatatagaccgggggtggtttctgaatcctctagtctatttcatggacttaacggtcccaaaccagatatattaatatttccttatggtagctgtacctttttaatactggggaaggcaactccctacccagcggaggaccatcgtggcaacgatgtgcctcacctgcagaacagctgagacagatgatgtgcaaagtgttttctcactggatttgcacaagtttggggagcctttctgccccccgtctttgttctttattagctgaagctaattcagagccacctgggtccgggagttggggacagcagaacgacttgacacatgttcatcactggcagagctggtcatgagccttttatataagcctttttcatcgggcctcagaggccctccttaaggaggtaccacattggtcagctgacttgcaaactcttctaaggccacttagattttctttttcaagtttgggttgtggcctggcatggtgatgtctgtaatcccagcagtttgcaaactgaggcaagagaatcgcttgaggccaggagtttgaggccagctagagtgacatagcaagactccgatgctacaaaaaagaataataatagtaattaactaaataaaatttgagctgaaatgtttttattctatgaccta

SEQ ID NO: 334465 - DNA, 1427 bp, Homo sapiens
cgcttgcgcagaagagactcccgggctcttaacgtcgggtatcaggagtttcttcccggagcaaggacccccaagacggaagaggatggccgcggcggctctgaggagattttggtcccggcgccgcgcagaggcgggcgacgcggtagtggcgaagccgggagtgtgggcgcggctggggtcctgggcccgcgcgctgctccgggactacgccgaggcctgcagggacgcttcggcggaggctagggcccggccggggcgcgccgctgtgtatgtgggtctgctgggcggcgcggcggcctgcttcacgctggcgcccagcgagggtgccttcgaggaggcgctgctggaggcgtcggggaccctcctgctgctggcgccggccacccgcaaccgcgagtccgaagccttcgtgcagaggctgctctggctgcggggccgtggccgcctgcgctacgtcaacctggggctctgctcgctggtgtacgaggcgcccttcgacgcccaggccagcctctaccaggcgcgttgccgctacctgcagccccgctggaccgacttccccggccgggtcctggacgtgggcttcgtgggtcgctggtgggtgctgggggcctggatgcgcgactgcgacatcaacgacgacgaattcctgcacctgccggcgcatttgcgggtggtcgggccccagcagctgcattccgagaccaacgagcggctcttcgatgagaagtacaagcctgtcgtgctcaccgacgatcaggtggaccaggcgctgtgggaggagcaggtcttgcagaaggagaagaaggacaggctcgccctgagccaggcccactcgctggtgcaggcggaggccccgagatgaaaccctgaggcccccgagtcctggcaaactgcttgcctggggtggtgcagttctgagtgtgcctcacctgcagaacagctgagacagatgatgtgcaaagtgttttctcactggatttgcacaagtttggggagcctttctgccccccgtctttgttctttattagctgaagctaattcagagccacctgggtccgggagttggggacagcagaacgacttgacacatgttcatcactggcagagctggtcatgagccttttatataagcctttttcatcgggcctcagaggccctccttaaggaggtaccacattggtcagctgacttgcaaactcttctaaggccacttagattttctttttcaagtttgggttgtggcctggcatggtgatgtctgtaatcccagcagtttgcaaactgaggcaagagaatcgcttgaggccaggagtttgaggccagctagagtgacatagcaagactccgatgctacaaaaaagaataataatagtaattaactaaataaaatttgagctgaaatgtttttattctatgaccta

SEQ ID NO: 334466 - DNA, 446 bp, Homo sapiens
ttgcataaaagtaccttttgggaaaggtaaaacgcagcaataaacatcctgagattagcaacatgaaattattttagatgacaggattatttgacatagaaaggatataatcaatgtgttcctattcctgataagcctgattatattcttagcaggttgttgttgggtatgattaggtattctctttagtaaagaaacataagagaactccagagtttatccatctatttatttctgtgtggttgaggtaaacagcttttacagactatattatgtaaagatatgccttacttggcagcaaaaatgcaatatgaagaaaataaacctagttttatccaattcagaggaaaacaagtacatttaaaaggataaaatctggccaggtgcagtggctcatgcctgtaatcccagcactttgggaggccgaggcgggcagatcacctgag

SEQ ID NO: 334467 - DNA, 493 bp, Homo sapiens
aatcactagtaggaagatgaatgtctattataaactcctgattactcatctcaaaaaaatcctagctattgcccagtgaccctaccatttatctctattagctcactctctcattctgctcaaagactttttcacatgttctagacattccttgaacatcttcctcttcctcttatctccccttactcttagccgatgactttggctttctctttggagggaacagaagccatatagcaggcgggtcctttgtcccactctctaagaatgcaattctatctgcacgtgtactcaattcctttttccctcctgtttcaatggagagatgtcccttgttttggagggcattgccctcttatgagatctgacaccctgctcttcctccaactcatgatcaaccatgtttatagccacacccagggccttgctatcctgggagccaggaaagtccaactcacagattttaaacccagtcattccattccttccccca

SEQ ID NO: 334468 - DNA, 500 bp, Homo sapiens
tgatgccctaaattaaaaaaatttttcttcaaacatgaacagaaaggtactgaactcctatgtacccatcacttagtttcagcagttatcactcagccaatcttgtttcatctgtactactcctcccccagttggattatttaggcttgtgtcactgatgtcattcgtctgtaaatatttcagtatctacttttgaagtataaagattttacaaaaatatccacaatatatagtgagttaattgtagtttgaatcttgtttaggaaaatttcttactgtgatgctataaaagtattcttttttattttctcctaaaatcttaaaattttaatctcttataattaagtccctaatccaaatgaaagttgtctcaataacatttactgaatagttcattctttttccattgatctgccataccatttctgacatgtattaaataatgctgcagcagatgtcttgtacatgtctgttaggctcttgtgtggatttctcttggg

SEQ ID NO: 334469 - DNA, 295 bp, Homo sapiens
aagagatgctagaagtgtggaattttatgtgaaatctcccaattttcagaagttggcttacatttttaaaacagtttataggacaaacaaaacaagtttgcagactggaattggctgcaggccaccaagttgcaggttctgacagctccactgtcactgggaggcatctggagctgattccaagctgctacgcccagcatcaggaagtgtcaactgtatgttcaccttccagctttcggctgccacacgctgtgtgctctagttacatgctctgacccgccacagaccacggtgg

SEQ ID NO: 334470 - DNA, 541 bp, Homo sapiens
ctctaggttgcttgtaagttttagaaattatgaataaaaagctgctataaacactggtgtgcaagtttttgtgttgacataagtctgaagttcctttgggtgaatgtcaaaggacacaactgctggattgtacagtaagagtaggtttgctcttgcaagaaactgcccacctgttttccaaacaggctgcacctatttttatattttcaccagcaacaaataagagttcctgttgctccacatcctcccagcatttgatgtgtggcagtgttatgaattttggccattctaataggtgtgtggtgcaaggatgcatcttcatcattgcaaatcagtggttttcaatatcggcatcactgaggaatttgttaaaaatgcagattcctgatccaaccctaaaccaactgaatgataaacatgggatagaagccagtcaggatcttttcacaagtcctccaggtgattctgatatacactgtcattactgaagtacgttaaagtttaagaataagtgcactaaggcaatcaatccatgaaaatc

SEQ ID NO: 334471 - DNA, 179 bp, Homo sapiens
ttaccaattcctgaccagaaaggatgccaagagatgctaaaaattgtttccaggaaaaagtaggacttgaatctcatggggatgaggctgagacttcttccaaggagcaatcagcttgcttcattattatgtctttctcaggagtttttcctgatctccgctcatcatggggaaaggca

SEQ ID NO: 334472 - DNA, 180 bp, Homo sapiens
ataggccgattggttttgactatctaggtttaccaataggtgaaaatcagattgtttttcccaagatgaaattatcttttcctggcttccttccgagttaagatctccagcttctggtccacattgcgtgagttaaaatcttggctctatcagttgctagcactgcgttactttgacgcg

SEQ ID NO: 334473 - DNA, 464 bp, Homo sapiens
agcgatctagaggatcccagtgcctcaccgcagaatgaaaaaggaaatgaggcgttaagtggccacagtaatttgtatttaaaaataaacttccttctgctgagggtttattagacacacaagtcaaaggaagtttaaacatttcctttaacaaaataggcaattatttttcagagacaatttaggtgtaaccttaacaggaaccacaaggtagaacagattcttctattatttgcacttatcaaggacagggattttggaagtgatcagagagccagcaaagagaaaaggttatttttgtagggagacagttacataagagagaacacgagtccacagatctgctcatctgaaggagttgggaaaatccagacagtgcatggacaggtggcacagcccaggtcactaccagcatggttgaagatgccttagacccattagacaggacaaagaaacgggtgctg

SEQ ID NO: 334474 - DNA, 313 bp, Homo sapiens
tccgtttttgtacaaatcccagtactgattccattcattttatagccctgcacttgtttttctttcactcccactttccatttgtgccactctgactcaccagatgagtctttgtaagcctcctaaaatccctctggaacaaggcgaggcacagaaaatagttttatagctgggcaatggatctgaagtggatctgaaagtaccttgtaaaaactgcatgggcataaactgctagtgtacaaaatgtgcaggtatgtaagacacctttcaatttcacagcgatttctttttagtgtgtgtgtgtgtgtgtgtg

SEQ ID NO: 334475 - DNA, 2273 bp, Homo sapiens
tcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaaggtacgaacctcctgccccaaatccaggcctgtagaagcagctgccgcagcttgtcttccccatttgcatagccttgtctgaaaactagactgctgaatactgaaggatcaggtttctcatcaagaaaactgcattttaaatgaatatcttgtatgtttatagggaagttactaatgtagtataaagagatgcctgtcctccccctcctttctggataagagattttatactttcacaaaacgaaaaattaatgatttgcagtgtagcaaacagtactgttacagtggttagggaaactttcccaaaagcaatctggagtgacatttcattcatgtattcatttaatgactatttattgaatgcctactatgtataaagtattgattctaccctcgaggaagttagtggaaatttttaaatgttagataaataaatagagattgattttcatattcacacacatttaaataaataaaacatagaaaattgtaagaaccataagagatagaatgctgtgggtattcaaagagagaaaatacttcagaaaaaggcgtaattgaggaggtaacatttgatctggtttctaaagggtagctaattactctatctttacaaagtgtgtgaatgtatatgagtgtttataaaatctgggtcaagtttgaatatacagagattgtagggaaggatgttctacacacagggtacagcaagatcaaagttgggagagactgagctatgtacaaagaatagcagtggttttagtttggctggactgtaaagtgcatggaggagaagttgcaaagaagattggaaacctgggtgggaaccacatcacggaagagctggaattcttagctatgaaaatttgtaccatattctgtaaacattttgggagccactgaaggttttagaatgagggaatcataagatcaaagcttgcttgggaagattaacactcttcccagtaaagttttggcaacagcatctgctgttatattgacataatgtgggtaaagtggctgacatagtatctgatgcataggagctcagtaagtcatggaagcagatatactgtagtggtttagagcaaaaactctggtgcctggatgcctgggttcaaaaaccagctctgccacttaatagctgtgtgattttgtacagatttcttaacctctctgtatggcagtttccccatctgtaaaataggattaaaaataatacctgttatgaattattatgagggtcaaatgagttaagacatgtaaaatacatagaacagtgctctattctgaataaagttctcaataaatgttagctgttgtcatcattattatcattctcattcatggaggagataaaatttaagctagcctttaaagaatggctgtgatgtagacatgtagaaaggtaactttcaggcacaagtaagtacacgacaaaaggcatacttgc

SEQ ID NO: 334476 - DNA, 1973 bp, Homo sapiens
tcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaagtacgaacctcctgccccaaatccaggcctgtagaagcagctgccgcagcttgtcttccccatttgcatagccttgtctgaaaactagactgctgaatactgaaggatcaggtttctcatcaagaaaactgcattttaaatgaatatcttgtatgtttatagggaagttactaatgtagtataaagagatgcctgtcctccccctcctttctggataagagattttatactttcacaaaacgaaaaattaatgatttgcagtgtagcaaacagtactgttacagtggttagggaaactttcccaaaagcaatctggagtgacatttcattcatgtattcatttaatgactatttattgaatgcctactatgtataaagtattgattctaccctcgaggaagttagtggaaatttttaaatgttagataaataaatagagattgattttcatattcacacacatttaaataaataaaacatagaaaattgtaagaaccataagagatagaatgctgtgggtattcaaagagagaaaatacttcagaaaaaggcgtaattgaggaggtaacatttgatctggtttctaaagggtagctaattactctatctttacaaagtgtgtgaatgtatatgagtgtttataaaatctgggtcaagtttgaatatacagagattgtagggaaggatgttctacacacagggtacagcaagatcaaagttgggagagactgagctatgtacaaagaatagcagtggttttagtttggctggactgtaaagtgcatggaggagaagttgcaaagaagattggaaacctgggtgggaaccacatcacggaagagctggaattcttagctatgaaaatttgtaccatattctgtaaacattttgggagccactgaaggttttagaatgagggaatcataagatcaaagcttgcttgggaagattaacactcttcccagtaaagttttggcaacagcatctgctgttatattgacataatgtgggtaaagtggctgacatagtatctgatgcataggagctcagtaagtcatggaagcagatatactgtagtggtttagagcaaaaactctggtgcctggatgcctgggttcaaaaaccagctctgccacttaatagctgtgtgattttgtacagatttcttaacctctctgtatggcagtttccccatctgtaaaataggattaaaaataatacctgttatgaattattatgagggtcaaatgagttaagacatgtaaaatacatagaacagtgctctattctgaataaagttctcaataaatgttagctgttgtcatcattattatcattctcattcatggaggagataaaatttaagctagcctttaaagaatggctgtgatgtagacatgtagaaaggtaactttcaggcacaagtaagtacacgacaaaaggcatacttgc

SEQ ID NO: 334477 - DNA, 442 bp, Homo sapiens
tcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgagaagctggatgagagcagtcaccagtttgtagggcaggaggcagctgagaggcagggtttgggcctcaggaccatccaggtggagccctgggagagagggtactgatcagcagactgggaggtggggagaagtccgctggtgttgttttagtgttatatatctttggtttttttaataaaatctttgaaaaccta

SEQ ID NO: 334478 - DNA, 1752 bp, Homo sapiens
ccatgggctttgggggtgggggtgggggcggtggacgaaagagcgttaggaagcggagaggacactgggctgggggaaatcttcagaaatttcgagtagctgtatcagatacctaaagctgtatcagaaggaagtgttctcatatcgtttctgagagcgcagcatgtctcttcgggacgtccaatggacaggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcacagcatatggtcctgattatgtgctggaaatcacgccaagctgccggccagaccgcaatgagccccaccgaatccaacaaatcctcaactacatcaaagggaatctgaagcatgtggtctagttgacagaaagagatcaggtttccagagctgaggagtggtgcctataatgaagacagcgtgtttatgcaagcagtttgtggaatttgtgactgcagggaaaatttgaaagaaattacttcctgaaaatttccaaggggcatcaagtggcagctggcttcctggggtgaagaggcaggcaccccagagtcctcaactggacctaggggaagaaggagatatcccacatttaaagttcttatttaaaaaaacacacacacacaaatgaaatttttaatctttgaaaattatttttaagcgaattggggaggggagtattttaatcatcttaaatgaaacagatcagaagctggatgagagcagtcaccagtttgtagggcaggaggcagctgagaggcagggtttgggcctcaggaccatccaggtggagccctgggagagagggtactgatcagcagactgggaggtggggagaagtccgctggtgttgttttagtgttatatatctttggtttttttaataaaatctttgaaaaccta

SEQ ID NO: 334479 - DNA, 1483 bp, Homo sapiens
tcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgagagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcacagcatatggtcctgattatgtgctggaaatcacgccaagctgccggccagaccgcaatgagccccaccgaatccaacaaatcctcaactacatcaaagggaatctgaagcatgtggtctagttgacagaaagagatcaggtttccagagctgaggagtggtgcctataatgaagacagcgtgtttatgcaagcagtttgtggaatttgtgactgcagggaaaatttgaaagaaattacttcctgaaaatttccaaggggcatcaagtggcagctggcttcctggggtgaagaggcaggcaccccagagtcctcaactggacctaggggaagaaggagatatcccacatttaaagttcttatttaaaaaaacacacacacacaaatgaaatttttaatctttgaaaattatttttaagcgaattggggaggggagtattttaatcatcttaaatgaaacagatcagaagctggatgagagcagtcaccagtttgtagggcaggaggcagctgagaggcagggtttgggcctcaggaccatccaggtggagccctgggagagagggtactgatcagcagactgggaggtggggagaagtccgctggtgttgttttagtgttatatatctttggtttttttaataaaatctttgaaaaccta

SEQ ID NO: 334480 - DNA, 776 bp, Homo sapiens
tcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaactcatcttccacatgaatgagaacatacgacgtttggttttccattcctgagttacttcacttagaataatagtctccaattccatccatgttgctatgaatgccattatctcattcctttttatggctgagtagtattccatggtgtatatataaaacattttctttatccacttgttgattgatgggcatttgggctggttccatatttttgcatttgcaaattgtgctgctataaacatgcgtgtgcaagta

SEQ ID NO: 334481 - DNA, 1756 bp, Homo sapiens
tcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcacagcatatggtcctgattatgtgctggaaatcacgccaagctgccggccagaccgcaatgagccccaccgaatccaacaaatcctcaactacatcaaagggaatctgaagcatgtggtctagttgacagaaagagatcaggtttccagagctgaggagtggtgcctataatgaagacagcgtgtttatgcaagcagtttgtggaatttgtgactgcagggaaaatttgaaagaaattacttcctgaaaatttccaaggggcatcaagtggcagctggcttcctggggtgaagaggcaggcaccccagagtcctcaactggacctaggggaagaaggagatatcccacatttaaagttcttatttaaaaaaacacacacacacaaatgaaatttttaatctttgaaaattatttttaagcgaattggggaggggagtattttaatcatcttaaatgaaacagatcagaagctggatgagagcagtcaccagtttgtagggcaggaggcagctgagaggcagggtttgggcctcaggaccatccaggtggagccctgggagagagggtactgatcagcagactgggaggtggggagaagtccgctggtgttgttttagtgttatatatctttggtttttttaataaaatctttgaaaaccta

SEQ ID NO: 334482 - DNA, 740 bp, Homo sapiens
tcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagagagacgtgtgtgtatgtggcactttacaaggcattctgaagaaatccaagtgaaatagaaaaaagattacctaatatagtggaaagcacactgctcaaagtcaggacacctgggctctacacctagtttttctaacttggctaactgacttggactgattaccctccctaggcctcagtttcttcatcaataaaatgaacaaaggatacaactaga

SEQ ID NO: 334483 - DNA, 1678 bp, Homo sapiens
tcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatggaacaggtgacgtgtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcacagcatatggtcctgattatgtgctggaaatcacgccaagctgccggccagaccgcaatgagccccaccgaatccaacaaatcctcaactacatcaaagggaatctgaagcatgtggtctagttgacagaaagagatcaggtttccagagctgaggagtggtgcctataatgaagacagcgtgtttatgcaagcagtttgtggaatttgtgactgcagggaaaatttgaaagaaattacttcctgaaaatttccaaggggcatcaagtggcagctggcttcctggggtgaagaggcaggcaccccagagtcctcaactggacctaggggaagaaggagatatcccacatttaaagttcttatttaaaaaaacacacacacacaaatgaaatttttaatctttgaaaattatttttaagcgaattggggaggggagtattttaatcatcttaaatgaaacagatcagaagctggatgagagcagtcaccagtttgtagggcaggaggcagctgagaggcagggtttgggcctcaggaccatccaggtggagccctgggagagagggtactgatcagcagactgggaggtggggagaagtccgctggtgttgttttagtgttatatatctttggtttttttaataaaatctttgaaaaccta

SEQ ID NO: 334484 - DNA, 830 bp, Homo sapiens
tcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaagtaagaaaatgacctttctgttttctgactctttccttgagtcagtttctcagttatgtaaactcttatgcttattgtattgacatttacagagagacgtgtgtgtatgtggcactttacaaggcattctgaagaaatccaagtgaaatagaaaaaagattacctaatatagtggaaagcacactgctcaaagtcaggacacctgggctctacacctagtttttctaacttggctaactgacttggactgattaccctccctaggcctcagtttcttcatcaataaaatgaacaaaggatacaactaga

SEQ ID NO: 334485 - DNA, 319 bp, Homo sapiens
ctggacaattcctttagagaaggtatcaaatagctcgttaaaccggattatcttcaaaatcacttccaatcttgagattataagatcctgggacaacgagtacttctaaaaagaattttgagactcctaaagaaatgatatcttgaccaatatttaggtcctctacctcctgacactcttttcagacaactatgaagaaatttaaaaggtataaccccataaggaggagacaacaatggaggacaggtggcaacaagtttctgtataatggaaagcagacagtggacttccaaggtgagatggcagattgaacacacac

SEQ ID NO: 334486 - DNA, 529 bp, Homo sapiens
tggtaattgttaaaaaaactgctgaggcaatttcaatgcccaacgagaggggctggcataacctattagagaccacgcattccacgcagtgccctgtggcctttcaaacagcttgtggaagaactggagacccacggggtgttaaattagaaaagtaaaattccagaatatacatggtatgatcttatacagaaacaaaacaaaaggggaaatccccgcccctccaggatgtgacgttctaccgctctcggcctcctggtctcccggccctggcctctgtgtcctctcacttcccatattaactctttcagcaagtcctgccagctctgcttgcaagccacagtctgtgtctctcctcctgtggcgctgatgcctggggaagccactgtcaccactgcctacttcagcccctgcagcccactctgcccagccgccagagggaaattttcaacgttaacaggctcacgttagtagccacacaccttccccagctccctactgtgcagaggacacagagactgggtggggg

SEQ ID NO: 334487 - DNA, 398 bp, Homo sapiens
ggtgagtgaatggcaggctattggttgaatgagtaggctgatggtttcgataataactagtatggggataaggggtgtaggtgtgccttgtggtaagaagtgggctagggcatttttaatcttagagcgaaggcctataatcactgcgcccgctcataaggggatggccatggctaggtttatagatagttgggtggttggtgtaaatgagcaaggcaggagtccgaggagggccattctacgcctccgcggaggcgttgaatggcctcaggaacacaagtgtctgaggattcatttactacttaaaggagcggaggctttttcaggtacttatgcagacttggctcagcatctttctgaaaagccaagagaaggtctcttaaagaccatcatcttgt

SEQ ID NO: 334488 - DNA, 427 bp, Homo sapiens
accgcgcctggtgagcaaagcttctaacctgactggcacacacagactgctcgtgctttgagtcccagttccagattctcaggagacagcttggccaggtgaaatctccctcatccagccagtttttgctaggatagtgttctctgagaaaagagggcacaggccagtccagctaaagaatattaccaccgcagacgtggctctcggtgggatgcatttgaccacttgcctgggaatccctatgtgctctgttaaacttcaggttcccgggccccaccccagacctaccacatcagaatccctggaagcattgcctcgacatggagtccgtgcccttcacttcaccactgtcccctccctggctaacttctgcctccaccctgcagccagcccccatgctgccgcagatgttgcaacataatggcac

SEQ ID NO: 334489 - DNA, 116 bp, Homo sapiens
gaccttagaacttagccaattaaaattctgagtttgagggacgtgtcagacaaaatcagtgtaaatgcggcatacattcatcatatttttatttataaagagtacaaactttccca

SEQ ID NO: 334490 - DNA, 307 bp, Homo sapiens
ataactcagaattctccctgagaaactaggaaggtatggcggcatgaattaaactggaatctggaagcaggtttgagtagaagacgatgaattcagaattggacaattgaaattgaagtgtctatgggacatctaaatggctatgtcttcagcctacacatctgagcctgaaacagaggttagtgatcgagctgtgaattgtgattgaagaataccctgaagttagaggtgtgaaaatgtgtgcagtcacctaaggagagcatgcagagcagggacccttagcctgagggccatgggtaggctccag

SEQ ID NO: 334491 - DNA, 287 bp, Homo sapiens
agggcttttctttctttcgtgtttaaaaattcttttactgtgagctgctgactttcctggttactttatctgtgggacttctttaaggcctggttgaagcaccttaatctctccagagaatatctgcttctgtcagttgcctaggaggactaccatccctgaacactttaaacgtaaatatccaaatgggtcttttcagatcacacaggtaatgtgaattcagactggaaatctgcctggaacctggtttgaggtaacaacttctaagggcaggtttttttcccctt

SEQ ID NO: 334492 - DNA, 544 bp, Homo sapiens
acctcagtttctctcaggcctatgagctgccccatctggtaaataggtggagagaacagagccggcaggggcctccagcagatactccagcccacagtctttgtccctgggtggctcactagagccagaagagaaggctcactaggacttgaatcctggcctggtcaccttccagctttgagaccttggacaaggcacttcatctcccacagtttccgaaagccgaattcatgagacggttgtgaggatttggggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggcaggcgcctcattaggtccaaggcacagtccagctgctgatcactcatggtggcggcggcggcggcggtcccggtcccggcgtcagtggctcccccccccgatacagcgaccaggggatccatcaagagt

SEQ ID NO: 334493 - DNA, 1714 bp, Homo sapiens
gtaaccggtacgcgaagggccttggggtgggcgaaaattccggactactgcagggggtgtggaaagggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334494 - DNA, 2056 bp, Homo sapiens
agctggcggcgtggggggcgggcccgggccgggccggggcggggaaggaaggtggcggcggcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgcaaaaatcaacacacagccccacactcaaaccacacacgggccgcgccccgcaccaaaagaaccccagcaagggggcgcccccaaggctcacccgcctgttacacgcagatgtcccgtcgtggtcacacactggggtgtgcccccttatatgtctgcactctctacttttcaaagcgcctccgcacactcgtgccccacctatttgttaaccaccggttgtagcgctctctgcactaatgcgccaacctagcgacacctctctgagacggctccccttatcctgccggcagaca

SEQ ID NO: 334495 - DNA, 1715 bp, Homo sapiens
agctggcggcgtggggggcgggcccgggccgggccggggcggggaaggaaggtggcggcggcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggaggagggatcttattcagctaatgttctcattctgcaagactcccctggaacttttgtagtattccctttgactgtgctacagatcggatttttggatcaagctttatagggtacctttgacctattcaccattatttgttt

SEQ ID NO: 334496 - DNA, 1750 bp, Homo sapiens
tgccctcctgccacttgacccttctgcaggacaggcccagcacttaggttggaagggccagagaacttcttcctgacaggatcaagggatttttggagcatgtttgtatgtggactttgggcctcaaagtgttttgaggaccatggttccttgtttagtcaagggatgttgctgctgaacgaggagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334497 - DNA, 1629 bp, Homo sapiens
ggctggtactggtcccgaatcggtaggatcgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334498 - DNA, 2177 bp, Homo sapiens
tggatgaggcggagcagacctggccttggaatctggccccgcgcttaagcgaggatggtcttcgtggcctttctgagcttggcttcctctgagtggcgggaagcctcattggtcatttttcagagccccttggtccactcctcggcactaagacacttgagaaaggctcctctcttcactcagcatgctatggggttacttaagtttatttcttaattgaattttctcattaaaacctgctttcccagatctgtttggcagcaggacagtttcgaggtggtagaagagaggcccagcttcctctgtatttcctttccctgactttctggaggcattatcgaagtacgctaagccgcacgtagctgaagtgcacaactggatggcttgtgtttgtttcagtgataacacacaacatctgcctccctgctctccccagcctcccgtctctgatcgcgcactccctagttttccagcctcttcttaagcagcgattccagctggcagcgccgtgacaagtgtttccgtaagcattcccacgatcctctaagtgaggagcatgacctcggaaccatgtgcccggtcccctcccctgacgtaggaggtagtgggagagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334499 - DNA, 1665 bp, Homo sapiens
gagtccgtggggctgccccaaaccggtcctgacaggcgtccttccatcgctggctgagcctttctccctttccctccacagtacatcgacgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334500 - DNA, 1992 bp, Homo sapiens
agctctccatcagggatggggtggtcccggtgctgtgccttctcagttgccgcttctagggaggccgcctaggagccagcgagggaagggcgggcatcggtgtgcccagaaggcagcgcgctgctctgcgggcccttctcgaggctgccgccgtgggtgctgtgcgtgcgaagcattctgcagggcaggccggggtccacggcgcccgggcctgagtgggagccgaggggcgaggatgggtggcccacaggacaaggatgaacgcacaatcgcccttgtgaggccgtggccttggggggccaccaggccctggatccagcatatggcctggacacgatgcacccaagcaggcgcagcctccccttccctctgaactgtcagcttgcaagggttggaactgctgattatggaagtccctcggatcagagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334501 - DNA, 1730 bp, Homo sapiens
acctcagtttctctcaggcctatgagctgccccatctggtaaataggtggagagaacagagccggcaggggcctccagcagatactccagcccacagtctttgtccctgggtggctcactagagccagaagagaaggctcactaggacttgaatcctggcctggtcaccttccagctttgagaccttggacaaggcacttcatctcccacagtttccgaaagccgaattcatgagacggttgtgaggatttggggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334502 - DNA, 1531 bp, Homo sapiens
agctggcggcgtggggggcgggcccgggccgggccggggcggggaaggaaggtggcggcggcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagccatcttatacttgagcctccatacttaaaaaaagaaaagaaaagaaatcaataaaaagaaactggggcgccaaaaaaaaacacactaacaactcccccacgaacaaaagaaaccctcaccacaagggggcgcccccctttaaatttcccctcgggggccccagttttggcgctccccaccttcttgtcccaaggggccca

SEQ ID NO: 334503 - DNA, 1716 bp, Homo sapiens
agctggcggcgtggggggcgggcccgggccgggccggggcggggaaggaaggtggcggcggcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334504 - DNA, 1396 bp, Homo sapiens
cattgtgtgtttgcagctgcattgtgtgtttgcagctgcattgtgtgtttgagtgatcagcagctggactgtgccttggacctaatgaggcgcctgcctccccagcaaatcgagggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334505 - DNA, 1318 bp, Homo sapiens
ttgctttttcctatgtgtaaaacccggcgcaacccgccggtctcttacttggaaaaaccttgccgagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334506 - DNA, 1291 bp, Homo sapiens
tgtgtcggtgacaagtgtagtggagcaacatgctttgacagtatcgagactgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334507 - DNA, 1616 bp, Homo sapiens
gtaaccggtacgcgaagggccttggggtgggcgaaaattccggactactgcagggggtgtggaaagggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334508 - DNA, 1659 bp, Homo sapiens
agctggcggcgtggggggcgggcccgggccgggccggggcggggaaggaaggtggcggcggcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagtttcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334509 - DNA, 1440 bp, Homo sapiens
agctggcggcgtggggggcgggcccgggccgggccggggcggggaaggaaggtggcggcggcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagacggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334510 - DNA, 1679 bp, Homo sapiens
acctcagtttctctcaggcctatgagctgccccatctggtaaataggtggagagaacagagccggcaggggcctccagcagatactccagcccacagtctttgtccctgggtggctcactagagccagaagagaaggctcactaggacttgaatcctggcctggtcaccttccagctttgagaccttggacaaggcacttcatctcccacagtttccgaaagccgaattcatgagacggttgtgaggatttggggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334511 - DNA, 1667 bp, Homo sapiens
  misc_feature (1204)..(1204): n is a, c, g, or t
agctggcggcgtggggggcgggcccgggccgggccggggcggggaaggaaggtggcggcggcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagaaaaaaaaaaaaaagaaaaaaaaaanaaagaaaaacaaaaaagaaaaaaaaaacacgaataagaaagcaaccacaaacgaataaataaattacatcacaagaagatactgaactcatgagctgtccccacatcaggcttaaaaacagatgcaattcccggacgtctaaacaaacactgtcaccgctacaccgacgggggtatactaaggcaagctctgaaatctgtggagcaaaacccaacaagtagcaatggaccaatcgtgccttagaacttaaatcgccctaaaaaagtcttcgaaaataagggaccggaatatacccctataaggaacccactcaaccccgtctagaggcgagagaagcgagcgtgtacgggcgagaaagtacacaaagatcgatactacaacaaagaaagggaggcaacaaacaaacaagaggcacagaagacagaacagacggcgcaaagggagaacaagaggggaaagagaa

SEQ ID NO: 334512 - DNA, 1309 bp, Homo sapiens
agctggcggcgtggggggcgggcccgggccgggccggggcggggaaggaaggtggcggcggcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagtatctccaattgcgtgacggctactgagcactagcatgtgccacatatcgctatcagtacccaccacagctccatagccgccctgctgagtgagtctgttcaccaggacccccgtcattcgcccacctaac

SEQ ID NO: 334513 - DNA, 1032 bp, Homo sapiens
gtgatacggtatcactgatagcttacgagtacactgaccagacagattgatatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334514 - DNA, 1155 bp, Homo sapiens
agctggcggcgtggggggcgggcccgggccgggccggggcggggaaggaaggtggcggcggcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccaaaagccatttgatcctagcagcccagcctggccaaacgacaaaggtctcgaggg

SEQ ID NO: 334515 - DNA, 2558 bp, Homo sapiens
catctcccgctggccatgttgacctcccgctgtgagcttggcaagaagcccctggggaatcggctgagatttggagcctgggggccgtgggggctgatgcctttggccgccgcagagccagggacagtcctgggaagatactcagaaacgtgtatttccccagcatgaaccaaatgtctgcgtttctcctgggagttttttcagttgtatgcagcttgcttccaggtcttgtcttatggcacctgctgagtattttgagggctcttcctgtgacttgtagggattcggtagccagaactcagtctgggtgctgttgcttctcctgggccctgcttcacttccatttgcccatttttgcttctggggattgatttttctgattcttccttcccatggctggtgtgaatcaaacgtgagagtccggctgagtgcactctccgtagcactcttcttgagcagccctctacccactctttccactgcttctaaactgttataaaacctacatttaggaagtctttgcctaaccaatatgttgggtaaatttgacaaaatgattaaagaattgctaggggggcattcctctgagcctcagtttcctcatctgtaaattgggttgatagcttttttcttttttaagccttgacttcgctttttgttgttgtcgttgtagagatggggtctcactatgttgcccaggctggtcttgaactcctggccttaaatgatcctcctgccttggcctcccaaagtgctgggattacaggcttgagccaccacatccggccgggttgatagttgagacttccccaggatgcccgtgaaaattaaatgagataatatatgtgaaaggcgttttgtaaactgtgaaatctccataagccttcattgtttctggctttgttgatgagcgtccccacacatacgtgaatgcggtcgccctgaacgtttccccacaaatccagaatttgacagcagggatcccaggggcacttggctgtcctgtgccgccctttgcaatccgggctgaggggttttctgggccaagttaacagcggatggtgcctcacagcagaggcctgaaagcacctgctgcgtgggccataaacacagtgtgctcagacacgcagagacactggttcttacccactcccaagggtgggataacgctgcaccttgcacttgtgggatgaggaatgaggctcttctgctgggcagggcctgggcaagggagaagcttttatagaggaacccgcatggccccggagtcctcccctcttagcccctggcctgagtccccagccagcaacccagggtagctgttctgaagcagaggggctttgttccattgtgtttggaagcccagaagccaccttgtggcttagggtgacatagggacctacacacagaggagtgaacttagggttctagggactatggccgggtcaccggtggccaggggcagagatgagcacctgtccatgtaagccatatgccacccccacagggcctggcaaggtgcagagggtgcaggtctcggccatgtacccctttgcccctttctgagaggggcagatgcccagcccagtgacccagagcctcaccccaggaagcgggtccatgcagcaaatcagccaggcactggcatggtggcccccaggcctccaccgcctcaccagtccctgttcaatctgctgataacgcctttcctcccttgcaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334516 - DNA, 876 bp, Homo sapiens
accgcgaaagtccatactgctcagtatggagcaggtcgtggtggacgaagttgttgctgcacacgccgagaaaccacactgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334517 - DNA, 933 bp, Homo sapiens
  misc_feature (5)..(5): n is a, c, g, or t
aagcngcaatgctaaacctctgtttcatgctaaccagacacgccgtgcactcgttagattcctttcttagaaaactcgttttctgctcccttccctcgtcccttccctccccgacaggtcacataacagctgcatctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334518 - DNA, 954 bp, Homo sapiens
agctggcggcgtggggggcgggcccgggccgggccggggcggggaaggaaggtggcggcggcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgagctgcctgagatgggatcctctagacgaca

SEQ ID NO: 334519 - DNA, 1017 bp, Homo sapiens
gtaaccggtacgcgaagggccttggggtgggcgaaaattccggactactgcagggggtgtggaaagggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334520 - DNA, 661 bp, Homo sapiens
ccgatagccaccctcctccggctttattctcaggaagagatggcgctgtgcggtcaatgatgcagctgttatgtgaccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334521 - DNA, 822 bp, Homo sapiens
tcgagctcggcacctattcgcaagggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334522 - DNA, 1233 bp, Homo sapiens
gtaaccggtacgcgaagggccttggggtgggcgaaaattccggactactgcagggggtgtggaaagggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtgcttctgaattgttggatcctgatgaatcgcaatcaggactatgtttggcttgagctccagcctcatgaccaccaaccccatcgaatgactgagagctgccaggctcctgccacgttggagctcagaatcctcccgtggggacactgtgctgcagccagcctccagggagccgcttgttttatggcctaaaaagtctctttatgctgagaaggtcacactggactttgctcacacagagatttgacccaagaaaaggaataaagaggccttggataccctgtcttgcccctgttcctgcccccgccgtaccctgctggctcatgccagaagactggacttgctgtctgtgggcatgtttgttgtcggctgacgtagcacccacaggcactggccgtgtgtgtgccacagtcaggaacgaggtgcctgccccccacccattaacccattagctttgtccttactccttgaggccctgcttgaaaagattaatggtgctttgggaggctgaggcaggaggattgcttgaggccgggagctcgagaccagcctgggcgacatagcaagaccctgtacctccaaaaaataaaatataaacattagtcaggcatagaggcacacacacacataggcctagctactcagctgaggtaggaggattgcttgagcccaggagttcaaggttacagtgagctatagtcatgccatcatacactcagcctgggtgacagagtgagtccttgtctctggaaaaaaaaa

SEQ ID NO: 334523 - DNA, 800 bp, Homo sapiens
gtaaccggtacgcgaagggccttggggtgggcgaaaattccggactactgcagggggtgtggaaagggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtgcttctgaattgttggatcctgatgaatcgcaatcaggactatgtttggcttgagctccagcctcatgaccaccaaccccatcgaatgactgagagctgccaggctcctgccacgttggagctcagaatcctcccgtggggacactgtgctgcagccagcctccagggagccgcttgttttatggcctaaaaagtctctttatgctgagaaggtcacactggactttgctcacacagagatttgacccaagaaaaggaataaagagtgacgcggccggctccaactccctccatctatcccctacgccatcctcacactcaccc

SEQ ID NO: 334524 - DNA, 1763 bp, Homo sapiens
agctggcggcgtggggggcgggcccgggccgggccggggcggggaaggaaggtggcggcggcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334525 - DNA, 1893 bp, Homo sapiens
agctggcggcgtggggggcgggcccgggccgggccggggcggggaaggaaggtggcggcggcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgccaaaaaaaaacacactaacaactcccccacgaacaaaagaaaccctcaccacaagggggcgcccccctttaaatttcccctcgggggccccagttttggcgctccccaccttcttgtcccaaggggccca

SEQ ID NO: 334526 - DNA, 1720 bp, Homo sapiens
  misc_feature (1559)..(1559): n is a, c, g, or t
agctggcggcgtggggggcgggcccgggccgggccggggcggggaaggaaggtggcggcggcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggagccccntggtccccacacatcatatcctccccatactcttgcagggcccagggctcgtgagcaacagttgggacacccgggccttggaggatgcaccccgtgttaggctttgcccaccggccaccaacactcctgtaattccaataaagcagttcattttttgagaa

SEQ ID NO: 334527 - DNA, 1965 bp, Homo sapiens
agctggcggcgtggggggcgggcccgggccgggccggggcggggaaggaaggtggcggcggcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttaaaaaaaacaaaaattaaaataatctcttataaataaaaaaacattctaaaaaatcaatatactaatcctaaaaaattaattggccgacatttaacaattttggaattggaaaaaccttggcgtaccccattaaatccctttgaaacaaattcccttttacccagttggctaaaaaccaaaaaggtctcaaccaatcgtcttttacaacatttgtcaaccttaaatggtaaatggcaaattttaacgctttattattttttaaaaaatcccctataaatttttttaaaatcactttaatttttaaaccaaatggctcaaaatctgaaacttcttaataactcaaagaattccaccagaaaaggttagatgattttccattctggaacaaaatttacttttaaataacttggtcttcaattaaaaggtcaccttttataagggcaatgcccacaattaaaccatcctctaactaagtttttgggctccagtcctctaagcctatctcaccctggggcccctcttttc

SEQ ID NO: 334528 - DNA, 1646 bp, Homo sapiens
gcggccgcccccggggagcccggcgggcgccggcgcgccccccccacccccaccccacgtctcgccgcgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334529 - DNA, 1739 bp, Homo sapiens
  misc_feature (21)..(21): n is a, c, g, or t
  misc_feature (23)..(23): n is a, c, g, or t
  misc_feature (26)..(26): n is a, c, g, or t
  misc_feature (33)..(33): n is a, c, g, or t
  misc_feature (52)..(53): n is a, c, g, or t
  misc_feature (65)..(65): n is a, c, g, or t
gacgtaaagaggctcgactgntntgntccaaanaagaaggccacggcgtttnntatataacgaancggcatacttacgtctagtacagctgtgcgatcgcacgagaccggagtgagcgcggctgctgcggggggaagcactgacgccgggaccgggacgcgcgccgccacatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334530 - DNA, 1749 bp, Homo sapiens
acctcagtttctctcaggcctatgagctgccccatctggtaaataggtggagagaacagagccggcaggggcctccagcagatactccagcccacagtctttgtccctgggtggctcactagagccagaagagaaggctcactaggacttgaatcctggcctggtcaccttccagctttgagaccttggacaaggcacttcatctcccacagtttccgaaagccgaattcatgagacggttgtgaggatttggggtgcgtgtaaactgcagatgtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334531 - DNA, 1885 bp, Homo sapiens
  misc_feature (1422)..(1422): n is a, c, g, or t
agctggcggcgtggggggcgggcccgggccgggccggggcggggaaggaaggtggcggcggcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaaaaaaaaaaaaaaaagaaaaaaaaaanaaagaaaaacaaaaaagaaaaaaaaaacacgaataagaaagcaaccacaaacgaataaataaattacatcacaagaagatactgaactcatgagctgtccccacatcaggcttaaaaacagatgcaattcccggacgtctaaacaaacactgtcaccgctacaccgacgggggtatactaaggcaagctctgaaatctgtggagcaaaacccaacaagtagcaatggaccaatcgtgccttagaacttaaatcgccctaaaaaagtcttcgaaaataagggaccggaatatacccctataaggaacccactcaaccccgtctagaggcgagagaagcgagcgtgtacgggcgagaaagtacacaaagatcgatactacaacaaagaaagggaggcaacaaacaaacaagaggcacagaagacagaacagacggcgcaaagggagaacaagaggggaaagagaa

SEQ ID NO: 334532 - DNA, 1771 bp, Homo sapiens
agctctccatcagggatggggtggtcccggtgctgtgccttctcagttgccgcttctagggaggccgcctaggagccagcgagggaagggcgggcatcggtgtgcccagaaggcagcgcgctgctctgcgggcccttctcgaggctgccgccgtgggtgctgtgcgtgcgaagcattctgcagggcaggccggggtccacggcgcccgggcctgagtgggagccgaggggcgaggatgggtggcccacaggacaaggatgaacgcacaatcgcccttgtgaggccgtggccttggggggccaccaggccctggatccagcatatggcctggacacgatgcacccaagcaggcgcagcctccccttccctctgaactgtcagcttgcaagggttggaactgctgattatggaagtccctcggatcagagtgatcagcagctggactgtgccttggacctaatgaggcgcctgcctccccagcaaatcgagggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334533 - DNA, 1306 bp, Homo sapiens
cctagaggatcccggattgagataagcacggtggaagcaacaatgcctttgaccagtatcgagactgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334534 - DNA, 1291 bp, Homo sapiens
agttcataaaatttttttgttttacattttttacaccaatgtaccaaaaaggtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334535 - DNA, 1663 bp, Homo sapiens
gtaaccggtacgcgaagggccttggggtgggcgaaaattccggactactgcagggggtgtggaaagggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334536 - DNA, 1876 bp, Homo sapiens
agctggcggcgtggggggcgggcccgggccgggccggggcggggaaggaaggtggcggcggcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgagatctattgatgctatccctgacaaccaaaagtttaagcagttgcagagggagctctctcaagtgctgacccagcgccagatctacatccagcctgataattaagccgatccaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334537 - DNA, 1040 bp, Homo sapiens
ctcggtacccggtggctatcgtggcaccatgaacctcggaggcagcccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334538 - DNA, 1166 bp, Homo sapiens
agctggcggcgtggggggcgggcccgggccgggccggggcggggaaggaaggtggcggcggcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccgctctatgtgcatctcttcatctgtatccaatgcgatatcctttataataaaccggtaaacataaa

SEQ ID NO: 334539 - DNA, 1852 bp, Homo sapiens
  misc_feature (21)..(21): n is a, c, g, or t
  misc_feature (23)..(23): n is a, c, g, or t
  misc_feature (26)..(26): n is a, c, g, or t
  misc_feature (33)..(33): n is a, c, g, or t
  misc_feature (52)..(53): n is a, c, g, or t
  misc_feature (65)..(65): n is a, c, g, or t
gacgtaaagaggctcgactgntntgntccaaanaagaaggccacggcgtttnntatataacgaancggcatacttacgtctagtacagctgtgcgatcgcacgagaccggagtgagcgcggctgctgcggggggaagcactgacgccgggaccgggacgcgcgccgccacatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgagatctattgatgctatccctgacaaccaaaagtttaagcagttgcagagggagctctctcaagtgctgacccagcgccagatctacatccagcctgataattaagccgatccaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334540 - DNA, 1096 bp, Homo sapiens
agctggcggcgtggggggcgggcccgggccgggccggggcggggaaggaaggtggcggcggcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaatctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334541 - DNA, 1164 bp, Homo sapiens
gtaaccggtacgcgaagggccttggggtgggcgaaaattccggactactgcagggggtgtggaaagggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcaaaatatttcctaacacaagccacagcctccatgatactaataatagccatcatcattaacctcctatattctggccaatggaccattacaaaaatattcaacccagtagcaataacaataataactctggccctagccataaaactaggactctcacctttccacttctgagtcccagaagtaacccccgatcagcat

SEQ ID NO: 334542 - DNA, 444 bp, Homo sapiens
agttcataaaatttttttgttttacattttttacaccaatgtaccaaaaaggtgggagggaagggaggctggcagacctaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgc

SEQ ID NO: 334543 - DNA, 372 bp, Homo sapiens
caggagggctgcacaggtgcagctgccactttcagaccacacacttcaagctagagcttggcctgcgcccctggtggttgggggttggaagagcagactgtgttgacagggtctttaattcacgattccaggtgcttctgaattgttggatcctgatgaatcgcaatcaggactatgtttggcttgagctccagcctcatgaccaccaaccccatcgaatgactgagagctgccaggctcctgccacgttggagctcagaatcctcccgtggggacactgtgctgcagccagcctccagggagccgcttgttttatggcctaaaaagtctctttatgctgagaaggtcacactggactttgctcacacagag

SEQ ID NO: 334544 - DNA, 474 bp, Homo sapiens
cctggtttaactgcctttatttgtcagtttctgtagaagaatgaagaaggtgatggcacccacgttacagggctgttcacgggaggtttaagtgagatcttacagagaaagcgcttagcaggtgccccaggtccagagtgtggggttggctgggagtcgtgtgcatctcctgccctgaccccctctgcaaacttgttcctgagtgcttgagtgaggcacacttgacctgcttatgtggttcccatggcaccatgatgtggggaatgtttcccaacaaggcaccttatcaagcgctctctctccactctgctgttcctaccacatatccctgggcaggtcaccctgcctttcttgttttcttttgaagacaggtctcgctcgatcacccaggccagagtacagtggcaaaatcatagctcactgcagctcctggactcaagggatcctcctgcctcagcctcctgaatagttggg

SEQ ID NO: 334545 - DNA, 98 bp, Homo sapiens
tttggagaatttgagctacagaatgcagtatttcaaagtaacttctacacacctgattactttacatcaaaaatggatattggttactttctgggcac

SEQ ID NO: 334546 - DNA, 438 bp, Homo sapiens
attttttctgtctgccagatgaaaaaaagaaattggatagacgcgttatggtagtggcaggtggtaatgtctgtcactctgaagacaaaaatctttctctcaatagagatttgaagggattttaaaatcccttagaaaaaaacaaaaacaactttaaaaactgttgcttaatttgggctgaaacacaattttccaaaacactatttctcgagatggcaagaagtttttaaaaactaatattttagcactttatgactcaaactctcaaatgtgaaatgcagctcttacttaaaattgttttcacagaaattttattttggaataaccacactggaattgttgctgctaaaaattgcctaaacccttgtcgtacctttttccatatacctgttgaggagcagaaggtggactggctaccacctgccccaagttgttctg

SEQ ID NO: 334547 - DNA, 541 bp, Homo sapiens
agactctatcgtacaaaaaaaaaataaaataaattaaagaagtaaataaataaatgatggcttatttcataatagttgtgactttgtaaagcttttaaatctgctttccccagagtctagcttttaaataaaatacaggatataaaaggtgggagcctcttgaatggaatgtgggggctttttctctctccccataggatagatatattctgtttcctgtcccccaccgagtcaagaataatttaagttttggcataagaaactgctgaaggaaagtgggttgaatcggctaatatttttcttctttttgcaggatatagaagacttagatcactgtgagatgaaagaagagcctactagtgagaagaagttggaggatgaaggaactgaaaaagaaaactgggcaatattagagaaaattaggaagactgaaaggcaaggccatttaaatgtgttgaccctgatagtcctttgcacagtgatcttcagatcttaaaagaaaaagaagagataggagacattttgcttatgttttaaggta

SEQ ID NO: 334548 - DNA, 654 bp, Homo sapiens
tcaggttttccttgttcccgcatgttcagccaatcgtgtttaaggagaaactaacaatgaaaacgggcttgttgatggaggaaaagttggaatgcagcctctggtgctgtttgagcgatccctctatcccgggtcgctgctgtgttctggaaaggcacattgtaccctggatgcagcagcttcatcagcaatggaagtggctgatatgtggactctgcagattatataaccttcctaagcacccgaatgttgagatgccagatcaaccactacccatgggtcagaatgggacaacagaagaagtgacttcaaaagaagaggaagaagaagagatggatgaagatatagaagacttagatcactgtgagatgaaagaagagcctactagtgagaagaagttggaggatgaaggaactgaaaaagaaaactgggcaatattagagaaaattaggaagactgaaaggcaaggccatttaaatgtgctgcagtgtctgggtcagtgcaagcttcagatagacttaagaaagagttcagggacttatacagatcacagagttataagacaggttgaccctgatagtcctttgcacagtgatcttcagatcttaaaagaaaaagaagagataggagacattttgcttatgttttaaggta

SEQ ID NO: 334549 - DNA, 635 bp, Homo sapiens
tcaggttttccttgttcccgcatgttcagccaatcgtgtttaaggagaaactaacaatgaaaacgggcttgttgatggaggaaaagttggaatgcagcctctggtgctgtttgagcgatccctctatcccgggtcgctgctgtgttctggaaaggcacattgtaccctggatgcagcagcttcatcagcaatggaagtggctgatatgtggactctgcagattatataaccttcctaagcacccgaatgttgagatgccagatcaaccactacccatgggtcagaatgggacaacagaagaagtgacttcaaaagaaaaaaaaaaaggaaaaggaggcggagcctgaggaacagggggaggattcatccagggacccccggttacggcgtttacagaaccgtattagtgaagatgtggaagagagattgcctcgacatcgaaaaataggggaacctgaagtggtaggagagagtgactcaaaagtagaaggagatgcttggcgcatggaacgagaagacagcagtgaagaagagggggaggaaattgatgatgaggaaatagagcggcggcgtggcatgatgcgtcagcgagcacaggagagaaaaattgaagagatggaagtcatggaagtgga

SEQ ID NO: 334550 - DNA, 538 bp, Homo sapiens
gttggctcagaaagtcaaggtggccctcatgtcttgatcccccagagtctgcatgtgtgagggctggagatgggggctgcagggcaggactcaggttttcactctgactgagcaggcctggtacatcatcactcaatgtccagagcgcaagatggtccatatttttggttgaggaagttatgggctcaagagattaaatcactttctggagcacagcatagttatctctccctctctctcttttatgggtaaaattatgagcataattctcaacccagctctgtaatagtagagaatgtgctctcatctgctccatggccagtgacattttggggctgaaatgctcagagtggaacaggtcagtggacctctggctccatccatgcctggtttggaacaaaggactggggaaggaaggaaggaaggaaggaaagaaggagggggacctccaccccaccaccctccgctgacatcatacactctgagaagctcctgactcaggccccctctgaggcactcctccccactactccactac

SEQ ID NO: 334551 - DNA, 489 bp, Homo sapiens
cagagtcagaaagcttgcaggtgggcaagtgtccaggagaagaaatgttggctcagaaagtcaaggtggccctcatgtcttgatcccccagagtctgcatgtgtgagggctggagatgggggctgcagggcaggactcaggttttcactctgactgagcaggcctggtacatcatcactcaatgtccagagcgcaagatggtccatatttttggttgaggaagttatgggctcaagagattaaatcactttctggagcacagcatagttatctctccctctctctcttttatgggtaaaattatgagcataattctcaacccagctctgtaatagtagagaatgtgctctcatctgctccatggccagtgacattttggggctgaaatgctcagagtggaacaggtcagtggacctctggctccatccatgcctggtttggaacaaaggactggggaaggaaggaaggaaggaaggaaagaaggagggg

SEQ ID NO: 334552 - DNA, 397 bp, Homo sapiens
attatagatatctacccaatcatcaaaataataaatgatctctgacactgcacaattaatgaatctatagaccttattcaaatcttccctatcttcccactgatgtcctttttctggaccatgatccaatttaggatcacaaattgcatctctttgttctgtcctctcagtctcctttaatctgggatagtgccgaaaatttctttagagttcatgaccttaacatttttgaagagtattggcgagttattttgtagaataaccctcagtttaggcttttctaattttttctcataattaaactcaggttatgcactttgggcaagaataccacagaggtgatgctgcgcgttattcatccatcatattaggatgccctaagatgtccatgtcactg

SEQ ID NO: 334553 - DNA, 190 bp, Homo sapiens
ccttttcttgaaaatgattacctatgttaggctttctgctagcaagagttctttaacagaaggtgactgtatatacacatttaactcacagcagcagcccaacgatagccaacctccaaccagggcctataaatacagtcctaaccctatatattccttagaagacaatttggaaatagagaactgatga

SEQ ID NO: 334554 - DNA, 222 bp, Homo sapiens
gatcacttgagtgcagaggtacgagaccagcctgggcaaacccccatctctaaaacagttagctaagcatggtggcacatgcctgtagtcccagctactcaagaggctgaggcaggaggatcgttagagcccaggaagttgaggctgcagtgagcagtgttcttgccactgcactctagccactgcactctagcctgggtcacaaagtgagaccttgtccct

SEQ ID NO: 334555 - DNA, 219 bp, Homo sapiens
ggttttctttcttctatgctgtcttgccacttctaatgttgcctcttctaatccctcttctgttatttatgcatatgggggaaggaaggaagagggaggtagtacgtgggtaaaggtaagaaacctcaaaatggaatgtggacttagggccgtatctacatcaggaatacaaaactttgtttaattttactttctaatatcatcatttttttttttttt

SEQ ID NO: 334556 - DNA, 154 bp, Homo sapiens
aagaaggcccgggccagtgtccttagggtttgggtaaagttgcaggtagtgagattgagaaggagccactggagggtaggaggaaatctagaggaatttgattttaaggaggttggtaatgacctttatagactattgtgtgtttggtctgaaa

SEQ ID NO: 334557 - DNA, 416 bp, Homo sapiens
agttcttagaggatccccttacaaccccacgatcaccaggctcctgccgtcccctcctcctccccttctccctctcgcggtctacactccagcctgggtaacaagagcgaaactccatctcaaaaaaaaagaagtgatgctagaaagagctggacagaagggaacaccaagacacctgtccatcttcacttagccaaatccagggccctgacaagatgggttttcaccaggacattttatggggctcctggctccccactatttctgacagtaggattcctaggtctgtgtcacctgtgagacagaaggggagccacattctggtggcagggacagaaccacacgcatggacactgatgtgccatcctggtccccacaggtcccctgaccagtacagctcctagaataggtcttct

SEQ ID NO: 334558 - DNA, 718 bp, Homo sapiens
ctgacacatacgccgtctggaaggatttgaggcaagacagacacatcagctggggaccctgacctggaggaagggtccgccacaggggcactataacaggtgtcagccccctctgacagtggcccagtccgagtctcccaaatcccaccactctagaggttggccacccaaccttgtcccctcctctgattcccaccattgttcccagtacctccaggaccaaggaatcctggcagcagttgaataagcaccttgctcccaccatctgggctgccactggtacggcaaagtgaggttgtcgaggcccccctgactgcactccgcccggaagccctggacaggctcctgccgtcccctcctcctccccttctccctctcgcggtctacactccagcctgggtaacaagagcgaaactccatctcaaaaaaaaagaagtgatgctagaaagagctggacagaagggaacaccaagacacctgtccatcttcacttagccaaatccagggccctgacaagatgggttttcaccaggacattttatggggctcctggctccccactatttctgacagtaggattcctaggtctgtgtcacctgtgagacagaaggggagccacattctggtggcagggacagaaccacacgcatggacactgatgtgccatcctggtccccacaggtcccctgaccagtacagctcctagaataggtcttct

SEQ ID NO: 334559 - DNA, 322 bp, Homo sapiens
ttccccatatccagtggcaaaaaaatgagggagagggaaggaaggaaggacggaaggagggaaggaaggagagagggaaggaaggaagtagggagggaggtagggatggaaggaaggaaggagagatggaagggaggaatgaaggaaggagggaaggagggcaggaaggaatgaaggaaaggaggaagtaaggaaagggaaggagggagggagggaaggaaggaaggtgagagggaaggaaggagagagggaaggaaagagagagggaaggaaggagagggaaggaaggaaagagggaaggaaggaaggagagaaggaagga

SEQ ID NO: 334560 - DNA, 133 bp, Homo sapiens
ctgggcatggtggtatgcactggtacttggaggcctgaggtgggatcacttgagcccaggagtttcaggttgcaatgagctatcatcacaccactgtccagaagctgggcaacagagtgggaccttgtcttca

SEQ ID NO: 334561 - DNA, 329 bp, Homo sapiens
aggcaattagaagtgtgcacctcatggaattcactgaattgtacgcttcaacaatagattttagcatacgtagcaccttctaatagaattaggaagaagttaaagataatcttaagaaatcacagaataattttgaccttatgccatgataaaaagttattttctcttattttctatcttctttattctcatgtaacgttcacatatatttaagtaatcaaataaattatggatactttggaatcccaaaatattagatctggtaaggatgtttagaatttatctagttcagcctgtttgctttactgaaaagaaactgaaacccagag

SEQ ID NO: 334562 - DNA, 205 bp, Homo sapiens
tctgatctgatcattcatataaaggcacagtttaagaagaagaatggctcttttctgcacaagcatcctattaatctgagggcccatctctcaacttctccgcatgagagccatactccctaggtggcagcacagatgcctgggatagcagtcactacctgagtccaccaggcacgctgcacatccgaggccacatgctaggctg

SEQ ID NO: 334563 - DNA, 156 bp, Homo sapiens
acatgggagtgtgagaaaggattcaaggcagaaaagtacacgctagttcagactttgaacctgagtctcaccactttcaaaccatgagtgggaaagtctctctaaaagactgttgctgtctgggtacagtggctcacacctgtaatcccagcactt

SEQ ID NO: 334564 - DNA, 531 bp, Homo sapiens
ggtttcaccatattgcacaggatggtttcgaacttctgaacccaagcaatccaccctccttggcatcccaaagtgttgggattacagaggcttacagctgcaggcttctttggcctcccatggcagcggcgcagccgaatggatggggcgtgtctctggaatgtgtgtccttgcatagcgtttatatcagaaagagctcctgagaagatccaaaaatgtttttatctcttacttccctgacaggttgaagccccaccccaatgtggctatttggagattaggcctttgggagataattagggttggatgaggtcatgaaggtggaaccctcgtgatgggataatggcttgataagaagaggaagagggagaggtcgctgtccctttccgccatgtaagcacacagcaggaaagcgactgtctacaagccaggaagagggcccttatcaggaaccaagtcggccaccactgtgatctgggactttgcagccttcagaactatggaaataaatgcctgttgcttaacccactc

SEQ ID NO: 334565 - DNA, 248 bp, Homo sapiens
acacgctcccaccgtcgactacagacgcctgcggttagaaagccctcggcatctgttcagcagacggtcctgccaggctcccctcattcagaggggacagaattctcctcctgacagactttctttttttttcctttttgggagggagtctccctctgtctcccaggctggagtgcagtggcgcgatctcggctcactgtaagctccgcctcccgggttcaggccattcctgcctcagcctcctgagt

SEQ ID NO: 334566 - DNA, 525 bp, Homo sapiens
gcagaggaatatataaagctggaatcttagggagagatctgggctggaaacatacattggagaagcatcagtatatagttgatatttaaagccatgagactggatgaagttacccagagagcaagaatcaattgcaaagatgttcaaggaccaagttctggagcacttcaatgtttacaggcttgggatatgaagaggaatcagcctagactgagcaaaagcctgcgaagtagtgatgatgaagttctggagcctaaagatggaagtgtttcaggaatagaggatatgggttgggcgtggtgtctcacatctgtattcacagcatttggggaggccaaggcaggtggattgcttgagcccaggagttcaagaccagcctggatgacatggtgaaaccccatctctaccaaaaaatgcaaaaattagctgcacgtggtggagtgcacctatagtagatccagcctggtcaacagagtgagaccttgtcttaaaaaaaaaaagagaatagagaaatgaccctctgtt

SEQ ID NO: 334567 - DNA, 238 bp, Homo sapiens
ccctccaaatgcgtatgtgagacagagcagataaacaaacacacattcaataacagaaatatacttatattaaggctgaacatacaaaatcaccatttttgtaggtcaaaagtagagtcaaatatcagcaatattgtatggttgtgcataataaaaatcatcaaaatgcagtgagagggtggatggctaagaggctgagctgacaaacacccccatcccatatcccatacacagctac

SEQ ID NO: 334568 - DNA, 624 bp, Homo sapiens
ttctgcttttccagaatcctgccctttccaaaaggaagacggtatgattaagttccagggtgaaattcaacagaaatgcttttggataaagatgttcaggcccacaaacaggcccctgtggacaaattgtgaaggaggtatgtagctttttctgctttacagctatcttattaagtaatcaaatgggaggtttgcctgacacagttcccagcttgacttttccctctggcttggtgatttgggggtcccgagatttatttttctttcacactttgcaagactatggatgcttaataggatgagattagcaattgaaagagaaaaaattttgattcctaaagtcttcaccctttccctcaaactcttttaaccttgttcttcttctaatggacatttgtgcatgattgaggtgtagtatcttaggtgctgtaggaaacagtaatattcaagaatgtgctgtgatctgcactaaggagaaggtgatgctactgaacaaggccaaaataaacctacctatggagaagtattcttgccgaaaacgatgaaccttaatctcatctgctttctaaatctaaattgtagtttaccagagccacagaagatattcaagaaaatgttaactga

SEQ ID NO: 334569 - DNA, 372 bp, Homo sapiens
ttgtccttgagtgttcacaactgtgtggcctttaatgggatgtctgcttgaaacagagtaagagcaggaagtgtctaaggggccaagccccatgttaataacaagtttgctgcttgaacattcagctaatttgaaaattagttcatttttaaatgccttttagcaatttgagtacttagaaaatttcttcggggaacttaacaacaaaaattcccacaaaaatgtcctaagggatggaaaaaaatctcccaattctcttagaatacttttaacttttcagcagaggtatccaaacatagagtgtgaatgttgaataaatatagtttaggacaaaaatagaaaatggagacttgttctcctagtgcgaaaaca

SEQ ID NO: 334570 - DNA, 333 bp, Homo sapiens
ccgttgtttagaagtttcaatagcagaggcagtgaaagaaaaatggctccctagttttagaagtttcaatagcatgttttggtcccacctcatctccctcctcacagttatccactcttcaaagcagaggaaacaagcccctaccgctgtcagtgctttgacctgactctactccaccatggtcaccaacaacctcctaatgatcaaaaccagcaatcttctcttcatttccatgtctccacacttgctcctgaagtgtagtcttgtcataaaaactactcacctcaccttggaatctttgactctgtttatcttacgtattccactattgct

SEQ ID NO: 334571 - DNA, 314 bp, Homo sapiens
tgggattattgccagtgggccactggccccctgtgcctggcccatttcttcatattgattgaattaaatgaattctaagcccagatgccactagagtggtcagaaattcaacctcagccctttctccactgtcctgtctcatcccagctcctaaagttgttccaaaggcaaaggtccatgactgtgagcaaaggagaacatgcatggtggcttctctggttttcctccctggtcatccttactagatcattgtcttggcccacctggtaccttaaagagatctgtgtgctgctcacaggatgcaccaccccttt

SEQ ID NO: 334572 - DNA, 770 bp, Homo sapiens
tgttgttacatagattgcctgtgatttaaggaaacacgatagccactatttactatttaccctgtgtcaagaatgtgatcctcccagcaacgcaatgagtcatattgcatgaccctcatcttatgaatgaagaaacagaagctcccagaggtgccactcgcccgtggtcacagagctggtgggagaatcactgagtgagtctgaggacagagaatgacacactgtggtttccaagagagaacatcaatgtttttgaccaactcgtaatttcaaagactggaaaaaccatgcttatatgcgcagcctcttttctgaggaacagactagaggatgtttgtttatgccagcagaaagcaaagccacttctagatcagatcacctgctgctgacagtcagatcaaatcaacagcactgaatgagctcctcccagggacagtgcagctgcctggaatttgaatgtggtatctggagcttcagtagtcatccaggactgtaagtgtgaaagccatgcactgagagtggtggaacagaaccctgttttctttagacgctgactcctgctgtctaccagatcctcgtggtacaatgactggtgtagactggcttgttgaagtcactctctggatctgagcaacgctggctgagccgtgatgaaagtattcctatccatcccactatgcttcacagtgggaatcttctcactgttcatcaccgtgccctagcagcgaggccttctcctcttcagatggactgcgggggccacgaaactc

SEQ ID NO: 334573 - DNA, 399 bp, Homo sapiens
accctggttgaaggaacctgttgttcttatggtggagggcagaaacccaagagggctggagccaatccatctgcctggaatttgaatgtggtatctggagcttcagtagtcatccaggactgtaagtgtgaaagccatgcactgagagtggtggaacagaaccctgttttctttagacgctgactcctgctgtctaccagatcctcgtggtacaatgactggtgtagactggcttgttgaagtcactctctggatctgagcaacgctggctgagccgtgatgaaagtattcctatccatcccactatgcttcacagtgggaatcttctcactgttcatcaccgtgccctagcagcgaggccttctcctcttcagatggactgcgggggccacgaaactc

SEQ ID NO: 334574 - DNA, 478 bp, Homo sapiens
gcgcctcggcagcccgccggctcccagtccggctccacgggcgctgcaggtgacccggcggcgcattccagcactccccgccgcccgggccaccgccgccaccgccaccgcaggcgccccggccgcgactcagccacaggaaagcggagagcgcccgagccggtgcgtgcgcggggctgggcgggggcgggggacccacgaatccagcagcccggaccccgggctcggaaacgcgacccggcctggggctcctgccttccggattcccggagatcccaggctgggggcagggagaggggagtcggggttccccaggccagacagaggagattccccctcgacctggggcggcgctgagacccaacgcgggccactctgcggactccgggccgcgatcgaaggagccacgccaggggcgatggggatccccgcacagggtcaggatccgcgtgcttgctagtccaccttaccgccggat

SEQ ID NO: 334575 - DNA, 731 bp, Homo sapiens
tacccataagtagtcattccccttccccagccccagtcaagccctaatcaaatttctgtctctatggatttgcctattctgcacatttcacgtaaacagaatcatatttaaatgacaatatgtggccttttgtgactagcttcttaaatttggcataatcatttcatagttcatccatgttatggcatgtaacagaacgatatttctttttattgcagaagagcagtttgctggatggataaaccacattttgtttacccatttgtcagttcatgaacatttgcataggtttcactttttggctattatgaataatgctgccatgaacaagattttatgtggacatatgctttcacttctaatggtatgtaagtaggggagggattgctgagtcataaggcaactaactttctgaggaactgccaaactgctttgtacagctgctgcaccattttatgttcccactcgcagtgtatgagggctccaatttctccacatcctcatcaacacttgctatggcctattttattttggccaccccagcccactctgtggttttgctttgcatttccctgatggctaatgatatccagcattttcatgcgcatattggtcacttgtatatcttctattcaaatcctttgcccatttttaaattgagttgtctttttgttgttgaattttaagagttcttaaatatgctggatacgagttcctgctcagacaaatat

SEQ ID NO: 334576 - DNA, 1120 bp, Homo sapiens
tgatagaatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatatggatgccccccaccctaccacaaaaaaaaaaaa

SEQ ID NO: 334577 - DNA, 1020 bp, Homo sapiens
gtagcataattttatgctctgtttttcccacttaactaggacatactgtttcatctgtcgccacacgtttcatgattttcattttaacagctacaagttgatatcccatgattcacttaccaatttccctcttgttacccctttgtttctagttcttcacttttgtaatcaatgcttctataattatttttctcatttgggattattttcagaaggtaaattaaaagtaatggtactggccgggcacggtggctcatgcctgcaatcacagctacttggggggctgaggcaggagaatcccttgaacccaagaggtggaggttgcagtgagccaagatcatgcccttgcactccagcctgggcaacaagtgcgaaactccatctcaaaaaacaaaaacaaaaaattatagtatataattatagcaaataacaaaataccatcatttatttcatgtaaaatttttctatgtagtcccattattagaattgagataaagtggagtttatttttaaaaataaatagcctgccattatgaaatgttttgcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatatggatgccccccaccctaccacaaaaaaaaaaaa

SEQ ID NO: 334578 - DNA, 1134 bp, Homo sapiens
tgatagaatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtcagtctgtatctacatggtgcaaatagcctgtttatctttgaaaatccaacaagcattcattaaataaacatgtatattctccag

SEQ ID NO: 334579 - DNA, 178 bp, Homo sapiens
catagaatttaatgctaagaaaatgtggccccagtattgccaacatgataacgatacaactcaggaatcatctgcaaggtaaaacatttaaaaatagagttggtcattcagtggttttatgactgggagaattaagagtgtttcttttaaaaattgctcatagaactgtgaatgtaat

SEQ ID NO: 334580 - DNA, 1155 bp, Homo sapiens
catagttttagaagtttcatagcaatgcgattgaaacttctaaaactcccaggcagcaatgatagactggattaagaaaatgtggcacatatacaccatggaatactatgcagccataaaaaatgatgagttcatgtcctttgtagggacatggatgaaattgaaaatcatcattctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatatggatgccccccaccctaccacaaaaaaaaaaaa

SEQ ID NO: 334581 - DNA, 313 bp, Homo sapiens
tgtctctagctacacctttgaccttgaatggccaaccgtgtgtctgggtactaccctggcatctgctctagtgggtccatatccgaatgcctggcctctgggactgcgcctgcaactttgaatcaccgcacactggcttctgcatgaatcgcagtgttgaccttgactgtcatatccggtcctgtgattatgtctgaattacttcggccatatttgtttctcaaatctgaatatccacagatgctatgtatctcccacccatctaacctttacagcaacctccaatttacagacgaaatggaggcacagtgag

SEQ ID NO: 334582 - DNA, 339 bp, Homo sapiens
ccaccccttctgccagcatcttgcacatcatgggagctcagtgtacactgacaggacttgcaggacacatacagcctttgaagctaaactaccctttggagaatcgtgactccctccacctctagccttcctgctttcagccatgataggcctaaagtctgagcagagctgctcaccaaggaaggactaagaggagccacaaggagcagctttatttaaagggagagatacaactgatcagcagcttttcctccttgcccctcatcttttcattgtcagtttcaaaacaggccagtgctagggccagagctaatagcagtggtggaagtggtcttggtt

SEQ ID NO: 334583 - DNA, 644 bp, Homo sapiens
aaccataatcgtacagaagtaataataaccataatagaaaaaataagccgggcatggtagcacgtgtctgtggtctcagctactcaggaggctgaggcaggaggatcacttgatcccaggagttctgtgctgatcaggtgtcctcattaagtttggcatccatgtggtgacctcccaggagtgggggaccaccaggttgcaaagcagcccaggttggaaatggagcaggtcaaagctctcttactgatcagtagtgggatcacatctgtgaagaggcattgcactccagcctgggcaacatagcgagaccccgcctctaaaaagaaagaaagaaaaaagaaaaataatagtgacaataacaattaaaaataaagagtatgccaggcgcggtggctcacgcctgtaatcccaacactttgggaggccaaggcgggtggatcacctgaggtcaggagtttgagaccagcctggccaacatggtgaaaccctgtctctactaaaaatacaaaaattagctgagcatggtggcaggcacctgtaatcatagctacttgggaggctgaggcaggagaatcccttgagcccaggaggcagaggttacagtgagctgagatcgtgccattgtactccagcctgggggacaa

SEQ ID NO: 334584 - DNA, 519 bp, Homo sapiens
ttctgtactcagatgtcacctccagggaatctttttcaaaaccctacacctctctgtcccctttccctgttttatttttcttcccagtatttatcactagctaacatcatatcagatacttctttgtttcttgtttctttgcctgctttatttactgctgtatgctagcacctagtatctagttgattggtagatgctttataaatatttattgcatgaatgaaggaaggaagtacctgcgccatttgtaaagtcaaaagagagacaggaagtttgcattctgggagaatggacacatgtcacaagcagaaaagctgtaagtcaatttagctattaaaatctgtattggttgttatataacaatgataaggctttagcacattttctaataatgggcatacttttactgaccttctctaaaattatgctttgaatgcgaaaataaattataattttaaatgtatttgtcaaccacttttatgaatagtatgcaagtttgagacctaaaattgcggtcat

SEQ ID NO: 334585 - DNA, 473 bp, Homo sapiens
tgtctactacagtagcccttaagccatatgtagctattgagcacttgacatgttgcaagagtgaattggagactgattttaattttatttaattttaatgtaagtagtcgcacatgacccgtggctactatggtagatggcatagttttagacaagggcagtagtcttgggtagatacttgatttacttagaacatttctttacctagctgtaacaaggttctaatagctgattaaaggacaacatttttagcatgtaatatacagtaaggaactaatgttaattactgccaagatgtataaacattatgaaaccttaaacaaggatgaacacagaagcagtggcccttctttgtaaataaggggtcagttacttcctaataggtgtcttagttttagttaataatctaatagcacccccaaaaagcaaactgttaatttgttattagccatcctgtaaagacaagggagaaa

SEQ ID NO: 334586 - DNA, 421 bp, Homo sapiens
cctagattctttggattgagtttcatctttctcctgaatgttgatgatcttcattcctattcacattctgaattctatttctgacattgcagtcatttaagcctggttaagaaccattgctggggaaccagtgtggtcacttggaaggaagaagacactggctttttgagtagctagagttcttgcactggttttttcacatgtgtgggctgatgttccttcagtctctgaagttgttgttctttggatgtgtttttttttcttatatcttctttgatgcccttgatggtttgattgtggtataagctgggttcactcaactcgctttgattctagtctgttcgtgggtcttgtaggagccccctccgattactgtctccatgcctgtatttcttttcttgggtgttctggtgcacagggc

SEQ ID NO: 334587 - DNA, 4224 bp, Homo sapiens
  misc_feature (2415)..(2415): n is a, c, g, or t
  misc_feature (2636)..(2636): n is a, c, g, or t
gaagagtggtgtttttttcttcttcttcttcttttgtggtttcacatagcaaatgagtgacagtctctacttacagacaaagtgagacgtcaggcattgagacatagctccatagaattcagtttctgagaaccagccagaagcatgcagtgacattgcacaatctgcctctgaagctggagatactagctgcagagctcaggggagctgctccacatcaccgacatgaagggaacaggcatcatggactgtgcgcccaaggcactcctggccagggcactttatgacaactgccctgactgctctgacgagctggctttcagcagaggggacatcctgaccattctggagcaacacgtgccagaaagcgagggttggtggaagtgtttgctccatgggaggcaaggcctggcccctgccaaccgcctccaaatcctcacggaggtcgctgcagacaggccgtgccccccattcctgagaggcctggaagaagctcctgccagctcagaggagacctatcaggtgcccactctaccccgccctcccactccaggccccgtttatgagcagatgaggagttgggcggaggggccccagccccctactgcccaagtctatgaattccccgaccctcccaccagtgccagaatcatctgtgaaaagactctcagctttccaaaacaggccatcctcacgcttcccagacctgtccgggcctcactgccgactctgccttcccaggtgtatgacgtgcctacccagcaccggggccccgtggtcctgaaggagccagagaagcagcagttatatgacataccagccagccccaagaaggcaggactccatcccccagacagccaagcaagtgggcagggtgttcccctgatatcagtgactaccttaagaagaggcggttacagcacattaccaaatcctcagaaatcggaatggatttatgacactccagtgtctccaggaaaggccagcgtcagaaacacgcctctcaccagctttgcggaagaatcaaggccccacgctctccccagttccagctccactttctacaatcctccaagtggcagatccaggtccctcactccacaactgaataacaatgtgcccatgcagaaaaaactcagccttccagaaattccttcttatggctttcttgtacccagaggcacatttcctttggatgaagatgtcagcaacaaggttccttcaagcttctctgattccccgagtggacagcagaacaccaagcccaatatagacatccctaaagcaacgtcgagtgtttctcaggctgggaaggagctggagaaagccaaggaggtgtcagagaattccgcgggccataattcctcatggttctccagacggacaacttccccatctcctgaaccggacagattatcaggttccagttctgacagcagagctagcatcgtttcctcgtgctccaccacatccaccgacgactcctccagctcttcctcggaggagtcagcaaaggagctctccttggacctggatgtggccaaggagacagtgatggctctgcagcacaaggtggtcagctctgtcgctggcctgatgctctttgtcagcaggaagtggagattccgagactatctggaggccaacattgatgcaatccacaggtccactgatcacatagaagcctctgtaagagaatttctggattttgcccgaggagtccatgggactgcctgtaacctcactgacagtaaccttcagaacagaattcgggaccagatgcagaccatctccaactcctaccgcatcctgcttgaaacaaaggaaagcttggataatcgcaattggcctctggaagttcttgtgactgacagtgtccagaacagcccagatgaccttgagaggtttgtcatggtggcacggatgcttccagaagacatcaagaggtttgcctccattgtcattgccaatggaaggctcctttttaagcggaactgtgaaaaggaagagactgtgcagttgaccccaaatgcagaatttaagtgtgaaaaatacatccagcctccccaaagagaaactgaatcacaccaaaagagtaccccttccactaagcaaagggaagatgaacactcttctgaactattaaagaaaaatagagcaaatatctgtggacagaatcctggccctcttatacctcagccttcgagtcaacagactcctgagaggaaaccccgcttatctgaacactgccggctgtactttggggcgctcttcaaagccatcagcgcatttcacggcagcctcagcagcagccagcccgcggagatcatcactcagagcaagctggtcatcatggtgggacagaagctggtggacacgctgtgcatggagacccaggagagggacgtgcgcaangagatcctccgcggcagcagtcacctctgcagcctgctcaaggacgtagcgctggccactaagaatgccgtgctcacataccccagccctgccgcgctggggcacctccaggcggaggctgagaagctggagcaacacacgcggcagttcagagggacactgggatgaggactgtctacctcccttcctcctctgctcacctctcagcttcacacccacancttgtgcaactctgccctatgggaaaagccagccggggcatacaccaatgagctgaaacagacctggtgcccaaagctggtagtaccaagtggctaagcaaccccagggcattgacttaccccgcagggggtcaggaaagagagtcaggtatgaggtaaagaccttgtgaagtttagcatatatggagtatgcagtatcagcttgaagtgacttcgcagaaataatattttatattgattaaatgtgtgcatgttttgtttgttttttgagacaaagtctcactctgtcacacaggctggagtgcagtggcgcgatctcagctcactgcaacctccgccttctgggttgaagcaattctcccgcctcagcctccagagtagctggtactacaggtgtgcgccaccatgcccagctaatttttgtatttttttttaatgaaaggtctcacatatttattactgaacccagccaaccaatgcattcataacagattcagaaagaaaaaatatattcccaataaaacatgtacaattctccagagagcggtgacattttcagcttgatgtggtaacatgactgtgaccttcagacagcataaatatgtgtgccctctcatgtgcaattccttatagggctagcttggttcttcttcaatgtctccttttggagttgtacctgattttattaccagttttcatctgaatccactggggagtggggcgattttgttttaatttctcggtcaggaatcacttaatcctggaagtcttatgagaagacatggcaagaagcagagtcaagcacacaccacaatggcagagaaaggaagagctaatttttgtatttttagtagagtcggggtttcaccatattagccaggctggtctggaactcctgacctcaggccatcccccgcctcggcctcccaaagtgctgggattacaggcctgagccaccattcctggcatgtacgtgttttaaattcactcatttaacacttatgtattggatgcctactacatgccaagttctaggtgctggagacatagcagtgtttcagagggcttgccctcttggaacttatgatctagtaggggagtcaggcagtaaagcggtgaagaaatacatacacagtatagcaggtgccaggaaaaacgtaagtaggggaagtgcaagagaacttatcttcaaatggttaatttttattgcatccattagataatagagtaagtttttgttgttttgaattgaattagttctgtgagattggtacaaattatgtatgtgtcttgcacccataaatatatatttttgctatgttactttaacctaaagatagatgttatatttacaacataacatgatctgttgggttctctattaatttatttcatacattatagattctgggttgataaattctgctcaatttgaaaaattttatattttgtctcaaatctgttacaatttatattggttggtgcaaaagtaattgcggtttttgccgtagacagtaatggcaaaaaccacaattgcttttgcaccaccctaataatattaaatataatcatgactttaaacatcatt

SEQ ID NO: 334588 - DNA, 2889 bp, Homo sapiens
  misc_feature (1080)..(1080): n is a, c, g, or t
  misc_feature (1301)..(1301): n is a, c, g, or t
attttactcttatcgtgctttccagaaagtttgcctgctgggagagtctttttgatcgtttcccatgtgttgtcagatagctccatagaattcagtttctgagaaccagccagaagcatgcagtgacattgcacaatctgcctctgaagctggagatactagctgcagagctcaggggagctgctccacatcaccgacatgaagggaacaggcatcatggactgtgcgcccaaggcactcctggccagggcactttatgacaactgccctgactgctctgacgagctggctttcagcagaggggacatcctgaccattctggagcaacacgtgccagaaagcgagggttggtggaagtgtttgctccatgggaggcaaggcctggcccctgccaaccgcctccaaatcctcacggaggtcgctgcagacaggccgtgccccccattcctgagaggcctggaagaagctcctgccagctcagaggagacctatcaggtgcccactctaccccgccctcccactccaggccccgtttatgagcagatgaggagttgggcggaggggccccagccccctactgcccaagtctatgaattccccgaccctcccaccagtgccagaatcatctgtgaaaagactctcagctttccaaaacaggccatcctcacgcttcccagacctgtccgggcctcactgccgactctgccttcccaggtgtatgacgtgcctacccagcaccggggccccgtggtcctgaaggagccagagaagcagcagttatatgacataccagccagccccaagaaggcaggactccatcccccagacagccaagcaagtaatcctggccctcttatacctcagccttcgagtcaacagactcctgagaggaaaccccgcttatctgaacactgccggctgtactttggggcgctcttcaaagccatcagcgcatttcacggcagcctcagcagcagccagcccgcggagatcatcactcagagcaagctggtcatcatggtgggacagaagctggtggacacgctgtgcatggagacccaggagagggacgtgcgcaangagatcctccgcggcagcagtcacctctgcagcctgctcaaggacgtagcgctggccactaagaatgccgtgctcacataccccagccctgccgcgctggggcacctccaggcggaggctgagaagctggagcaacacacgcggcagttcagagggacactgggatgaggactgtctacctcccttcctcctctgctcacctctcagcttcacacccacancttgtgcaactctgccctatgggaaaagccagccggggcatacaccaatgagctgaaacagacctggtgcccaaagctggtagtaccaagtggctaagcaaccccagggcattgacttaccccgcagggggtcaggaaagagagtcaggtatgaggtaaagaccttgtgaagtttagcatatatggagtatgcagtatcagcttgaagtgacttcgcagaaataatattttatattgattaaatgtgtgcatgttttgtttgttttttgagacaaagtctcactctgtcacacaggctggagtgcagtggcgcgatctcagctcactgcaacctccgccttctgggttgaagcaattctcccgcctcagcctccagagtagctggtactacaggtgtgcgccaccatgcccagctaatttttgtatttttttttaatgaaaggtctcacatatttattactgaacccagccaaccaatgcattcataacagattcagaaagaaaaaatatattcccaataaaacatgtacaattctccagagagcggtgacattttcagcttgatgtggtaacatgactgtgaccttcagacagcataaatatgtgtgccctctcatgtgcaattccttatagggctagcttggttcttcttcaatgtctccttttggagttgtacctgattttattaccagttttcatctgaatccactggggagtggggcgattttgttttaatttctcggtcaggaatcacttaatcctggaagtcttatgagaagacatggcaagaagcagagtcaagcacacaccacaatggcagagaaaggaagagctaatttttgtatttttagtagagtcggggtttcaccatattagccaggctggtctggaactcctgacctcaggccatcccccgcctcggcctcccaaagtgctgggattacaggcctgagccaccattcctggcatgtacgtgttttaaattcactcatttaacacttatgtattggatgcctactacatgccaagttctaggtgctggagacatagcagtgtttcagagggcttgccctcttggaacttatgatctagtaggggagtcaggcagtaaagcggtgaagaaatacatacacagtatagcaggtgccaggaaaaacgtaagtaggggaagtgcaagagaacttatcttcaaatggttaatttttattgcatccattagataatagagtaagtttttgttgttttgaattgaattagttctgtgagattggtacaaattatgtatgtgtcttgcacccataaatatatatttttgctatgttactttaacctaaagatagatgttatatttacaacataacatgatctgttgggttctctattaatttatttcatacattatagattctgggttgataaattctgctcaatttgaaaaattttatattttgtctcaaatctgttacaatttatattggttggtgcaaaagtaattgcggtttttgccgtagacagtaatggcaaaaaccacaattgcttttgcaccaccctaataatattaaatataatcatgactttaaacatcatt

SEQ ID NO: 334589 - DNA, 303 bp, Homo sapiens
cacggccagtggttggtgggtttcaaaactctttgtcttttttctgtagaacttttaccctaaagaaattccattctaaatgccaatatgtaaaatagatcaaaggcttgattagaagagagttggagagctggggtcccaccaatccccaaggatggggaacctgagggttctgtggatcacttgagagtggaaacacaggaacatgactagggaaaggaggggttcacagaaatgaaagaggggcaaacaacatcccactttaaacatgaaagctgaaaatcttcaacccattcttagttg

SEQ ID NO: 334590 - DNA, 361 bp, Homo sapiens
ggccgttgctgaacttcaacattggccaccaatatctgctgtctgtgcttaaaggatcaaaaatgcagacctcagtcaggcgcagtggttcacgcctgtaatcccagcactttgggaggccaaggtgggcagatcacttgaggtaaggagttcaagaccagtttggccaatatgatgaaaccctgtctctacaaattagacaggcgtggtggtgggtgcctgaaatcccagctacctgggaggctgaggcaggagaattgcttgaatccagaaggcagaggctacagtgagttgagattgcgcctctgcactccagcctgtgcaacatgtgcaacagaacaagaccctatctacaaaaaaa

SEQ ID NO: 334591 - DNA, 924 bp, Homo sapiens
cgatagcacctgcccgcctgcctgtcctccagcaggaagtagcaagtccccagacttttgcaggcgggaaccatgtctcaggctgcaaaggcctcggcctcggccacagtggcggtgaacccagggcctgacaccaaggggaagggggccccacctgcaggaacatcccctagtcccggcactaccctggccccaacaaccgtgcctattaccagcgccaaggcggcggaactgcctcctgggaactacaggctggtggtcttcgaactggaaaacttccagggccgtcgagcagaattctcgggggagtgctcaaatctggcagaccgtggcttcgaccgtgtgcgcagcatcattgtctccgcgggaccctgggtcgcctttgagcagtccaacttccgcggggagatgttcatcctggagaagggcgagtaccctcgctggaacacatggtcgagcagctaccgcagtgatcggctcatgtccttccggcccatcaaaatggatgcccaggagcacaaaatctccctgtttgaaggggccaacttcaagggcaacaccatagagatccagggggacgacgcacccagtctctgggtctacggcttcagtgaccgcgtgggcagcgtgaaggtctccagtggaacatgggttggctatcagtatcctggctaccgcgggtaccagtacctcctagagcctggtgacttccggcactggaatgagtggggagccttccagccacagatgcagtccctgcgtcgcctgcgtgacaagcagtggcacctcgaggggtccttccctgtcctggccacagagccccccaagtgagtccacacctcactctgctaccttgccccaacccttcttcatgttcaattatttcccccatttttcccaggcaaataaaattccctaaagcca

SEQ ID NO: 334592 - DNA, 497 bp, Homo sapiens
tctagagaaacagtgtgctcagataatcacacacatttatctcacttaatccttcaccaactccaaggaaacaggcatatgagtgtagatgagaaacaaaggctcagagagctgggtcgcctttgagcagtccaacttccgcggggagatgttcatcctggagaagggcgagtaccctcgctggaacacatggtcgagcagctaccgcagtgatcggctcatgtccttccggcccatcaaaatggatgcccaggagcacaaaatctccctgtttgaaggggccaacttcaagggcaacaccatagagatccagcttgccccaacccttcttcatgttcaattatttcccccatttttcccaggcaaataaaattccctaaagccaaaatttctcctggatctgtaaacagatgtgtgccttgaggtcccccatagttactgggatgtgacttcctcgctcttaataattacaacgataataaaagcagcaaacactg

SEQ ID NO: 334593 - DNA, 1036 bp, Homo sapiens
cgatagcacctgcccgcctgcctgtcctccagcaggaagtagcaagtccccagacttttgcaggcgggaaccatgtctcaggctgcaaaggcctcggcctcggccacagtggcggtgaacccagggcctgacaccaaggggaagggggccccacctgcaggaacatcccctagtcccggcactaccctggccccaacaaccgtgcctattaccagcgccaaggcggcggaactgcctcctgggaactacaggctggtggtcttcgaactggaaaacttccagggccgtcgagcagaattctcgggggagtgctcaaatctggcagaccgtggcttcgaccgtgtgcgcagcatcattgtctccgcgggaccctgggtcgcctttgagcagtccaacttccgcggggagatgttcatcctggagaagggcgagtaccctcgctggaacacatggtcgagcagctaccgcagtgatcggctcatgtccttccggcccatcaaaatggatgcccaggagcacaaaatctccctgtttgaaggggccaacttcaagggcaacaccatagagatccagggggacgacgcacccagtctctgggtctacggcttcagtgaccgcgtgggcagcgtgaaggtctccagtggaacatgggttggctatcagtatcctggctaccgcgggtaccagtacctcctagagcctggtgacttccggcactggaatgagtggggagccttccagccacagatgcagtccctgcgtcgcctgcgtgacaagcagtggcacctcgaggggtccttccctgtcctggccacagagccccccaagtgagtccacacctcactctgctaccttgccccaacccttcttcatgttcaattatttcccccatttttcccaggcaaataaaattccctaaagccaaaatttctcctggatctgtaaacagatgtgtgccttgaggtcccccatagttactgggatgtgacttcctcgctcttaataattacaacgataataaaagcagcaaacactg

SEQ ID NO: 334594 - DNA, 1092 bp, Homo sapiens
  misc_feature (1050)..(1050): n is a, c, g, or t
cgatagcacctgcccgcctgcctgtcctccagcaggaagtagcaagtccccagacttttgcaggcgggaaccatgtctcaggctgcaaaggcctcggcctcggccacagtggcggtgaacccagggcctgacaccaaggggaagggggccccacctgcaggaacatcccctagtcccggcactaccctggccccaacaaccgtgcctattaccagcgccaaggcggcggaactgcctcctgggaactacaggctggtggtcttcgaactggaaaacttccagggccgtcgagcagaattctcgggggagtgctcaaatctggcagaccgtggcttcgaccgtgtgcgcagcatcattgtctccgcgggaccctgggtcgcctttgagcagtccaacttccgcggggagatgttcatcctggagaagggcgagtaccctcgctggaacacatggtcgagcagctaccgcagtgatcggctcatgtccttccggcccatcaaaatggatgcccaggagcacaaaatctccctgtttgaaggggccaacttcaagggcaacaccatagagatccagggggacgacgcacccagtctctgggtctacggcttcagtgaccgcgtgggcagcgtgaaggtctccagtggaacatgggttggctatcagtatcctggctaccgcgggtaccagtacctcctagagcctggtgacttccggcactggaatgagtggggagccttccagccacagatgcagtccctgcgtcgcctgcgtgacaagcagtggcacctcgaggggtccttccctgtcctggccacagagccccccaagtgagtccacacctcactctgctaccttgccccaacccttcttcatgttcaattatttcccccatttttcccaggcaaataaaattccctaaagccaaaatttctcctggatctgtaaacagatgtgtgccttgaggtcccccatagttactgggatgtgacttcctcgctcttaataattacaacgataataaaagcagcaaacactgggatagtacacacngaccggggccgcgttttgttgttttttgttcctaccccagtc

SEQ ID NO: 334595 - DNA, 792 bp, Homo sapiens
cgatagcacctgcccgcctgcctgtcctccagcaggaagtagcaagtccccagacttttgcaggcgggaaccatgtctcaggctgcaaaggcctcggcctcggccacagtggcggtgaacccagggcctgacaccaaggggaagggggccccacctgcaggaacatcccctagtcccggcactaccctggccccaacaaccgtgcctattaccagcgccaaggcggcggaactgcctcctgggaactacaggctggtggtcttcgaactggaaaacttccagggccgtcgagcagaattctcgggggagtgctcaaatctggcagaccgtggcttcgaccgtgtgcgcagcatcattgtctccgcgggaccctgggtcgcctttgagcagtccaacttccgcggggagatgttcatcctggagaagggcgagtaccctcgctggaacacatggtcgagcagctaccgcagtgatcggctcatgtccttccggcccatcaaaatggatgcccaggagcacaaaatctccctgtttgaaggggccaacttcaagggcaacaccatagagatccagagccccccaagtgagtccacacctcactctgctaccttgccccaacccttcttcatgttcaattatttcccccatttttcccaggcaaataaaattccctaaagccaaaatttctcctggatctgtaaacagatgtgtgccttgaggtcccccatagttactgggatgtgacttcctcgctcttaataattacaacgataataaaagcagcaaacactg

SEQ ID NO: 334596 - DNA, 571 bp, Homo sapiens
  misc_feature (10)..(10): n is a, c, g, or t
ttcatgcggnactgactctcttaactaccaccgctacacgatgcccaggagcacaaaatctccctgtttgaaggggccaacttcaagggcaacaccatagagatccagggggacgacgcacccagtctctgggtctacggcttcagtgaccgcgtgggcagcgtgaaggtctccagtggaacatgggttggctatcagtatcctggctaccgcgggtaccagtacctcctagagcctggtgacttccggcactggaatgagtggggagccttccagccacagatgcagtccctgcgtcgcctgcgtgacaagcagtggcacctcgaggggtccttccctgtcctggccacagagccccccaagtgagtccacacctcactctgctaccttgccccaacccttcttcatgttcaattatttcccccatttttcccaggcaaataaaattccctaaagccaaaatttctcctggatctgtaaacagatgtgtgccttgaggtcccccatagttactgggatgtgacttcctcgctcttaataattacaacgataataaaagcagcaaacactg

SEQ ID NO: 334597 - DNA, 591 bp, Homo sapiens
gcgccgccgagcgacaaggcatccccgtaatttttactcggcggccgccttctggtggtcttcgaactggaaaacttccagggccgtcgagcagaattctcgggggagtgctcaaatctggcagaccgtggcttcgaccgtgtgcgcagcatcattgtctccgcgggaccctgggtcgcctttgagcagtccaacttccgcggggagatgttcatcctggagaagggcgagtaccctcgctggaacacatggtcgagcagctaccgcagtgatcggctcatgtccttccggcccatcaaaatggatgcccaggagcacaaaatctccctgtttgaaggggccaacttcaagggcaacaccatagagatccagagccccccaagtgagtccacacctcactctgctaccttgccccaacccttcttcatgttcaattatttcccccatttttcccaggcaaataaaattccctaaagccaaaatttctcctggatctgtaaacagatgtgtgccttgaggtcccccatagttactgggatgtgacttcctcgctcttaataattacaacgataataaaagcagcaaacactg

SEQ ID NO: 334598 - DNA, 332 bp, Homo sapiens
tgctatttgtcctttgctatagtagccagacaggtatcttagtttagaatatcatctactttgttaattagtttgtttattttctcagaataagtgaattgcaaccactctctttattatagtataacaaaattggattataaattaaaagatgtagattttagtgccagctcccttctatgttaggctatttgtatctattaattccttttcaggaatgagtaaataattatttcagtctttccttcccaggtaatctctactgattctttatgtttaagttcaaatattacttcctcaagaaagccttccctgaactgtcagttgagatg

SEQ ID NO: 334599 - DNA, 102 bp, Homo sapiens
gtacaatagaaacgctgtacatggcatttaaaggcaaattggattttcttctggcagccaccctggacttcagacttgcaggccccagagcacagtttatct

SEQ ID NO: 334600 - DNA, 429 bp, Homo sapiens
attccggggatacacgtgcagttattacttgggtatattgtgtgaagctgaggtttggacctctaatgttcctgttgccacaacagtgaacacagtacccagcacgcagtttttcagcccttgccccctccctcccgctctccctccttgcttttggagttcccagtgtctactgttcccatctttatgtccatgtgtacccaagacttatctcccacttacaagtgagagcatgcagtatttagttttcttgttctgcgttagttccgttaggataattgcctccagttacattcatgtcactgcaaaggatttgatttcattctttttaatggctgtgtagtattccatgttgtataggtaacacattttctttatccactcatcaattaatgggcacttacattgatttcatgtgtttgctattgt

SEQ ID NO: 334601 - DNA, 176 bp, Homo sapiens
aaaatgttaactttcctcatgaactggcattctttctttttatcagagaagaattatatataatgtttcccattttgcctttaatttccaggaaacccagagcttaattttaatgctcaggtacagtaattgtaaaaactgagggttttgtgtattttttatccctcttctgtggc

SEQ ID NO: 334602 - DNA, 660 bp, Homo sapiens
caatcagctctctgtaaaatagcaatcggctctctgtaaaatggatcaatcccaggatgtgggtggggccacataagagaataaaggcaggctgcctgagctagcagtggcaatcctctgaggaggtctccttgtatactggaagccttgctttttggctttctgaaataaattttgctgctgctcgctctttgggtccaccctgcgtttaagagctgtaacactccctgtgaaggtctgcagcttcactcctgaagccagccagaccgtaaacccaccagaaggaagaaactcctaacacatcagaacatcagaaggaacaaactctggacacaccacctttaagaactgtaacactcaccgcaagggtccgtggcttgattcttgaagtcagtgagaccaagaacccaccaattccggacacacagccacccatccacttatccacccatccactcacctatctatccatccatccctccatccacacatccactccatccatccatccatgcaacaatccatccatccaaccacccacccacctacacatccagtcatccacccatccatcagctgattcattcctccatccatctgttctcccatccatccattcacccatccaatcattcactcatccatccattcacccgtcca

SEQ ID NO: 334603 - DNA, 454 bp, Homo sapiens
tttgattttaaagtgtcagactccaaaggctgtgctttttctcttggcctggctgcagtgtagcaggggagcaccttggaagaggcatgtgcttattgcagttgaccatgcttgagtacaggattttgagagatggaggcaaaagaactttgaagaaggtgttggaggggtccggagacacaaagaaatacaaaaatactgtatgcactcactaatacagtccctagatcaatgatgtgtagaaagcataatgctcaactgaaaggagaaaaaaatccttctcatagcttaagagaacctgaagtgtcctctcagaaaaacatatttgaggccgggtgcagtggctcacgccagtaatcccagcacttcgggaggctgaggtgggcagaccacttgaggtcaggagttcacgaccaggctagccaacatggtgaaaacccatctctgctaaaaa

SEQ ID NO: 334604 - DNA, 217 bp, Homo sapiens
tttgatgcaagaaatgtcttctgtccattggcttcctagcttcccacctccttcccctccagcaagtctcacatactatgttcttctacaacgctctgtagtctgtggaggaagtaaaagcccgccactgtctagtgccctcatcttccacagccacaatgcatgcgtcattttttctgggagcattcaggtagttgaggaccattcaataatggac

SEQ ID NO: 334605 - DNA, 273 bp, Homo sapiens
ttctgtgccttcttatgtaaataaatgattatattttcaatacttttgtgtatattgatagccctgtagaactaataatgcagtctactcattgggacttggagcttaaatggaaatgaccaagatggattagaaggatatgaaaaataaagaaggaggtgaggggaaccaagggcttagaaagggagcgggagagtcagcggaatgacaaatgtctgaaagactgtgatggatgggatggcatgtcttgagtcaagagtggactgtgcttgg

SEQ ID NO: 334606 - DNA, 2236 bp, Homo sapiens
ggggggctgacaacaactgtgataggtacgaggctgggtgtggatcggccgacgctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggaaccagatcctgaattgccagtgcatcaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggcttccatgcttacaagtcctgatggaccatttataaatttatctaggctgaatttaacaaagtattcccagaaacctaagttggcaaaggctttgtttgagtatatctttcatcatgaaaatgatgttaagactgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacaccatcaaatcattattt

SEQ ID NO: 334607 - DNA, 2116 bp, Homo sapiens
ggggggctgacaacaactgtgataggtacgaggctgggtgtggatcggccgacgctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggctttgtttgagtatatctttcatcatgaaaatgatgttaagactgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacaccatcaaatcattattt

SEQ ID NO: 334608 - DNA, 2152 bp, Homo sapiens
ggggggctgacaacaactgtgataggtacgaggctgggtgtggatcggccgacgctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggcagcttggatcttaaaagcaagagcgctaacagaaatggtatacatagatgaaattgatgtagatcaggaaggaattgcagaaatgatgctggatgataatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggcttccatgcttacaagtcctgatggaccatttataaatttatctaggctgaatttaacaaagtattcccagaaacctaagttggcaaaggctttgtttgagtatatctttcatcatgaaaatgatgttaagactgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacaccatcaaatcattattt

SEQ ID NO: 334609 - DNA, 1849 bp, Homo sapiens
tattactttggtattaccaaagtagctttatattatggtatatcattttcccctgttgttatagtggagaattatatggaagatttttgaaggtgattatttttatttatgttgcctttatatttttatgcatattaaacttgtttacatttcaagagaaagtttcagatctcttggtctattgtttttcctctgtaggcttccatgcttacaagtcctgatggaccatttataaatttatctaggctgaatttaacaaagtattcccagaaacctaagttggcaaaggctttgtttgagtatatctttcatcatgaaaatgatgttaagactgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacaccatcaaatcattattt

SEQ ID NO: 334610 - DNA, 840 bp, Homo sapiens
ggggggctgacaacaactgtgataggtacgaggctgggtgtggatcggccgacgctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggcttccatgcttacaagtcctgatggaccatttataaatttatctaggctgaatttaacaaagtattcccagaaacctaagttggcaaaggctttgtttgagtatatctttcatcatgaaaatgatgttaagactgctttggatctggctgccctctccacagaacattctcagtacaaggactggtggtggaaagtacagattggaaaatgttactacaggttgggaatgatcggaacaaaaacacgttatagccgagaacgaggaaggagaactttggctgga

SEQ ID NO: 334611 - DNA, 398 bp, Homo sapiens
ttttacacaactcttgagaacacttctgtaggaagactaaagttaattttttggattcttattgaatgagttagagttcacctacaaatacttggttggtccttaggactttttattttagaaactgtatttcttaaaactgtttactgccttcttaatgctttccaggaaccagatcctgaattgccagtgcatcaggtaaagaaaggtttagctgcaacctttagtttagagaattctttaatgctattgcttagttgttgctatagattagaaaatttgctgcatatcttcctgtgggtttataaaattagccatatctgtcagacattctgtgccttcttatgtaaataaatgattatattttcaatacttttgtgtatattgatagccctgta

SEQ ID NO: 334612 - DNA, 448 bp, Homo sapiens
taaattctatcagctttcccatagccttgtattactttggtattaccaaagtagctttatattatggtatatcattttcccctgttgttatagtggagaattatatggaagatttttgaaggtgattatttttatttatgttgcctttatatttttatgcatattaaacttgtttacatttcaagagaaagtttcagatctcttggtctattgtttttcctctgtaggcttccatgcttacaagtcctgatggaccatttataaatttatctaggctgaatttaacaaagtattcccagaaacctaagttggcaaagggtatgtacttaaaatgattttgagttatgaagtaatattacacgtatgatgataatgacaaattagaaaatgaataaaaacttgtgaaggaaaggccatgtctttattgaagtggaaatgttttatatgt

SEQ ID NO: 334613 - DNA, 2206 bp, Homo sapiens
ggggggctgacaacaactgtgataggtacgaggctgggtgtggatcggccgacgctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggcttccatgcttacaagtcctgatggaccatttataaatttatctaggctgaatttaacaaagtattcccagaaacctaagttggcaaaggctttgtttgagtatatctttcatcatgaaaatgatgttaagactgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacaccatcaaatcattattt

SEQ ID NO: 334614 - DNA, 2122 bp, Homo sapiens
ggggggctgacaacaactgtgataggtacgaggctgggtgtggatcggccgacgctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggcttccatgcttacaagtcctgatggaccatttataaatttatctaggctgaatttaacaaagtattcccagaaacctaagttggcaaaggctttgtttgagtatatctttcatcatgaaaatgatgttaagactgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacaccatcaaatcattattt

SEQ ID NO: 334615 - DNA, 246 bp, Homo sapiens
ggggaagaagtgagaaaaggcagattctgcaaaagagttaagaaataaggggtggcttagccatgggaggcagagaggaagggcaaagagaaggttttcaatggaaccaaaaagaaacacattaagggaaatgagaaccttgaagcagcggcttcacaagttcagagggaaatatttacctggagtataagtagagaaagaaaatcaccgagcttcaataaagtgattggtggtctatggtggcaa

SEQ ID NO: 334616 - DNA, 449 bp, Homo sapiens
gaaaataaaacactctatgttctcacttgtaagtggaagctaagctatgggtatgcaaggcatacagagtggtataatggaaactggagacctagaagggggagagtgggaggggtgaggggtaaaatctatgtactgggtgcactgtacagtactcgggtgacgggtacactaagatctcagactctgccactatacagttcatccctgttatacagttcatccatgccactaaaaccacgggtacccccaaagctattaaaataaaaaggtaacaaattaataaaaatttcattaattttttaaaaagaaaagatccctgtgaaggaaactgtaacccagggctgaaggactgatatgtccctgaggcaggcagcaagggtgtggcactggccttgccaactgaaagcaaactgcttctggtgggtcttacggacagggatggagaa

SEQ ID NO: 334617 - DNA, 1176 bp, Homo sapiens
  misc_feature (51)..(51): n is a, c, g, or t
atacccgcatcaactataaaaaatggttgcaccaaacaaagaacacttagnaatttcccatgtcctactttgcaatgtaacccagagggtatcattctggtttgtggttacagacccttcaaaaaatcacacccttcctgctgttgaggtgcaatcagccataagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtagaagaaagaacaaagaaccatctgaagtggatgacgctgaagataagtgtgaaaacatgatcacaattgaaaatggcatcccctctgatcccctggacatgaagggagggcatattaatgatgccttcatgacagaggatgagaggctcacccctctctgaagggctgttgttctgcttcctcaagaaattaaacatttgtttctgtgtgactgctgagcatcctgaaataccaagagcagatcatatattttgtttcaccattcttcttttgtaataaattttgaatgtgcttgaaagtgaaaagcaatcaattatacccaccaacaccactgaaatcataagctattcacgactcaaaatattctaaaatatttttctgacagtatagtgtataaatgtggtcatgtggtatttgtagttattgatttaagcatttttagaaataagatcaggcatatgtatatattttcacacttcaaagacctaaggaaaaataaattttccagtggagaatacatataatatggtgtagaaatcattgaaaatggatcctttttgacgatcacttatatcactctgtatatgactaagtaaacaaaagtgagaagtaattattgtaaatggatggataaaaatggaattactcatatacagggtggaattttatcctgttatcacaccaacagttgattatatattttctgaatatcagcccctaataggacaattctatttgttgaccatttctacaatttgtaaaagtccaatctgtgctaacttaataaagtaataatcatctctttttgattgtgaaataa

SEQ ID NO: 334618 - DNA, 1306 bp, Homo sapiens
tgtttcctgaatgaagatagcctatctaagaaccaggtgcagaaaatgcttttaaagtgagacttagtatcagaacagctctgggagataaagcatatgcctgggataccaatgaagaatacctcttcaaagcgatggtagctttctccatgagaaaagttcccaacagagaagcaacagaaatttcccatgtcctactttgcaatgtaacccagagggtatcattctggtttgtggttacagacccttcaaaaaatcacacccttcctgctgttgaggtgcaatcagccataagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtagaagaaagaacaaagaaccatctgaagtggatgacgctgaagataagtgtgaaaacatgatcacaattgaaaatggcatcccctctgatcccctggacatgaagggagggcatattaatgatgccttcatgacagaggatgagaggctcacccctctctgaagggctgttgttctgcttcctcaagaaattaaacatttgtttctgtgtgactgctgagcatcctgaaataccaagagcagatcatatattttgtttcaccattcttcttttgtaataaattttgaatgtgcttgaaagtgaaaagcaatcaattatacccaccaacaccactgaaatcataagctattcacgactcaaaatattctaaaatatttttctgacagtatagtgtataaatgtggtcatgtggtatttgtagttattgatttaagcatttttagaaataagatcaggcatatgtatatattttcacacttcaaagacctaaggaaaaataaattttccagtggagaatacatataatatggtgtagaaatcattgaaaatggatcctttttgacgatcacttatatcactctgtatatgactaagtaaacaaaagtgagaagtaattattgtaaatggatggataaaaatggaattactcatatacagggtggaattttatcctgttatcacaccaacagttgattatatattttctgaatatcagcccctaataggacaattctatttgttgaccatttctacaatttgtaaaagtccaatctgtgctaacttaataaagtaataatcatctctttttgattgtgaaataa

SEQ ID NO: 334619 - DNA, 1545 bp, Homo sapiens
  misc_feature (1)..(4): n is a, c, g, or t
nnnncttttgaggtagagtcagagtagggaaaacaactaatctgttttccaaacaggttttcataaataactgacaggagatgggctgtttttatggaagtattaacccaaatgatgggtgttaatcattaaacctttttggtggtggctcgcttgtttctctgatattctaatccgggtcgacagaatggctaaggcagatttaagtgcagcgtggattttttttttctcactttgccttgtgttttccaccctgaaagaatgttgtggctgctcttttttctggtgactgccattcatgctgaactctgtcaaccaggtgcagaaaatgcttttaaagtgagacttagtatcagaacagctctgggagataaagcatatgcctgggataccaatgaagaatacctcttcaaagcgatggtagctttctccatgagaaaagttcccaacagagaagcaacagaaatttcccatgtcctactttgcaatgtaacccagagggtatcattctggtttgtggttacagacccttcaaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtagaagaaagaacaaagaaccatctgaagtggatgacgctgaagataagtgtgaaaacatgatcacaattgaaaatggcatcccctctgatcccctggacatgaagggagggcatattaatgatgccttcatgacagaggatgagaggctcacccctctctgaagggctgttgttctgcttcctcaagaaattaaacatttgtttctgtgtgactgctgagcatcctgaaataccaagagcagatcatatattttgtttcaccattcttcttttgtaataaattttgaatgtgcttgaaagtgaaaagcaatcaattatacccaccaacaccactgaaatcataagctattcacgactcaaaatattctaaaatatttttctgacagtatagtgtataaatgtggtcatgtggtatttgtagttattgatttaagcatttttagaaataagatcaggcatatgtatatattttcacacttcaaagacctaaggaaaaataaattttccagtggagaatacatataatatggtgtagaaatcattgaaaatggatcctttttgacgatcacttatatcactctgtatatgactaagtaaacaaaagtgagaagtaattattgtaaatggatggataaaaatggaattactcatatacagggtggaattttatcctgttatcacaccaacagttgattatatattttctgaatatcagcccctaataggacaattctatttgttgaccatttctacaatttgtaaaagtccaatctgtgctaacttaataaagtaataatcatctctttttgattgtgaaataa

SEQ ID NO: 334620 - DNA, 1535 bp, Homo sapiens
  misc_feature (1)..(4): n is a, c, g, or t
nnnncttttgaggtagagtcagagtagggaaaacaactaatctgttttccaaacaggttttcataaataactgacaggagatgggctgtttttatggaagtattaacccaaatgatgggtgttaatcattaaacctttttggtggtggctcgcttgtttctctgatattctaatccgggtcgacagaatggctaaggcagatttaagtgcagcgtggattttttttttctcactttgccttgtgttttccaccctgaaagaatgttgtggctgctcttttttctggtgactgccattcatgctgaactctgtcaaccaggtgcagaaaatgcttttaaagtgagacttagtatcagaacagctctgggagataaagcatatgcctgggataccaatgaagaatacctcttcaaagcgatggtagctttctccatgagaaaagttcccaacagagaagcaacagaaatttcccatgtcctactttgcaatgtaacccagagggtatcattctggtttgtggttacagacccttcaaaaaatcacacccttcctgctgttgaggtgcaatcagccataagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtagaagaaagaacaaagaaccatctgaagtggatgacgctgaagataagtgtgaaaacatgatcacaattgccttcatgacagaggatgagaggctcacccctctctgaagggctgttgttctgcttcctcaagaaattaaacatttgtttctgtgtgactgctgagcatcctgaaataccaagagcagatcatatattttgtttcaccattcttcttttgtaataaattttgaatgtgcttgaaagtgaaaagcaatcaattatacccaccaacaccactgaaatcataagctattcacgactcaaaatattctaaaatatttttctgacagtatagtgtataaatgtggtcatgtggtatttgtagttattgatttaagcatttttagaaataagatcaggcatatgtatatattttcacacttcaaagacctaaggaaaaataaattttccagtggagaatacatataatatggtgtagaaatcattgaaaatggatcctttttgacgatcacttatatcactctgtatatgactaagtaaacaaaagtgagaagtaattattgtaaatggatggataaaaatggaattactcatatacagggtggaattttatcctgttatcacaccaacagttgattatatattttctgaatatcagcccctaataggacaattctatttgttgaccatttctacaatttgtaaaagtccaatctgtgctaacttaataaagtaataatcatctctttttgattgtgaaataa

SEQ ID NO: 334621 - DNA, 1589 bp, Homo sapiens
  misc_feature (1)..(4): n is a, c, g, or t
nnnncttttgaggtagagtcagagtagggaaaacaactaatctgttttccaaacaggttttcataaataactgacaggagatgggctgtttttatggaagtattaacccaaatgatgggtgttaatcattaaacctttttggtggtggctcgcttgtttctctgatattctaatccgggtcgacagaatggctaaggcagatttaagtgcagcgtggattttttttttctcactttgccttgtgttttccaccctgaaagaatgttgtggctgctcttttttctggtgactgccattcatgctgaactctgtcaaccaggtgcagaaaatgcttttaaagtgagacttagtatcagaacagctctgggagataaagcatatgcctgggataccaatgaagaatacctcttcaaagcgatggtagctttctccatgagaaaagttcccaacagagaagcaacagaaatttcccatgtcctactttgcaatgtaacccagagggtatcattctggtttgtggttacagacccttcaaaaaatcacacccttcctgctgttgaggtgcaatcagccataagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtagaagaaagaacaaagaaccatctgaagtggatgacgctgaagataagtgtgaaaacatgatcacaattgaaaatggcatcccctctgatcccctggacatgaagggagggcatattaatgatgccttcatgacagaggatgagaggctcacccctctctgaagggctgttgttctgcttcctcaagaaattaaacatttgtttctgtgtgactgctgagcatcctgaaataccaagagcagatcatatattttgtttcaccattcttcttttgtaataaattttgaatgtgcttgaaagtgaaaagcaatcaattatacccaccaacaccactgaaatcataagctattcacgactcaaaatattctaaaatatttttctgacagtatagtgtataaatgtggtcatgtggtatttgtagttattgatttaagcatttttagaaataagatcaggcatatgtatatattttcacacttcaaagacctaaggaaaaataaattttccagtggagaatacatataatatggtgtagaaatcattgaaaatggatcctttttgacgatcacttatatcactctgtatatgactaagtaaacaaaagtgagaagtaattattgtaaatggatggataaaaatggaattactcatatacagggtggaattttatcctgttatcacaccaacagttgattatatattttctgaatatcagcccctaataggacaattctatttgttgaccatttctacaatttgtaaaagtccaatctgtgctaacttaataaagtaataatcatctctttttgattgtgaaataa

SEQ ID NO: 334622 - DNA, 1172 bp, Homo sapiens
  misc_feature (39)..(39): n is a, c, g, or t
cgcgaaaagcaagcaggacgacataatacccaacaaganaaacccttaatttcccatgtcctactttgcaatgtaacccagagggtatcattctggtttgtggttacagacccttcaaaaaatcacacccttcctgctgttgaggtgcaatcagccataagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtagaagaaagaacaaagaaccatctgaagtggatgacgctgaagataagtgtgaaaacatgatcacaattgaaaatggcatcccctctgatcccctggacatgaagggagggcatattaatgatgccttcatgacagaggatgagaggctcacccctctctgaagggctgttgttctgcttcctcaagaaattaaacatttgtttctgtgtgactgctgagcatcctgaaataccaagagcagatcatatattttgtttcaccattcttcttttgtaataaattttgaatgtgcttgaaagtgaaaagcaatcaattatacccaccaacaccactgaaatcataagctattcacgactcaaaatattctaaaatatttttctgacagtatagtgtataaatgtggtcatgtggtatttgtagttattgatttaagcatttttagaaataagatcaggcatatgtatatattttcacacttcaaagacctaaggaaaaataaattttccagtggagaatacatataatatggtgtagaaatcattgaaaatggatcctttttgacgatcacttatatcactctgtatatgactaagtaaacaaaagtgagaagtaattattgtaaatggatggataaaaatggaattactcatatacagggtggaattttatcctgttatcacaccaacagttgattatatattttctgaatatcagcccctaataggacaattctatttgttgaccatttctacaatttgtaaaagtccaatctgtgctaacttaataaagtaataatcatctctttttgattgtgaaataa

SEQ ID NO: 334623 - DNA, 1201 bp, Homo sapiens
  misc_feature (15)..(15): n is a, c, g, or t
taggaagaatatggntagagggaggttggtcacttcgcttttttgaatcccctacaatcatgaagcgaaccttgagaatttcccatgtcctactttgcaatgtaacccagagggtatcattctggtttgtggttacagacccttcaaaaaatcacacccttcctgctgttgaggtgcaatcagccataagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtagaagaaagaacaaagaaccatctgaagtggatgacgctgaagataagtgtgaaaacatgatcacaattgaaaatggcatcccctctgatcccctggacatgaagggagggcatattaatgatgccttcatgacagaggatgagaggctcacccctctctgaagggctgttgttctgcttcctcaagaaattaaacatttgtttctgtgtgactgctgagcatcctgaaataccaagagcagatcatatattttgtttcaccattcttcttttgtaataaattttgaatgtgcttgaaagtgaaaagcaatcaattatacccaccaacaccactgaaatcataagctattcacgactcaaaatattctaaaatatttttctgacagtatagtgtataaatgtggtcatgtggtatttgtagttattgatttaagcatttttagaaataagatcaggcatatgtatatattttcacacttcaaagacctaaggaaaaataaattttccagtggagaatacatataatatggtgtagaaatcattgaaaatggatcctttttgacgatcacttatatcactctgtatatgactaagtaaacaaaagtgagaagtaattattgtaaatggatggataaaaatggaattactcatatacagggtggaattttatcctgttatcacaccaacagttgattatatattttctgaatatcagcccctaataggacaattctatttgttgaccatttctacaatttgtaaaagtccaatctgtgctaacttaataaagtaataatcatctctttttgattgtgaaataa

SEQ ID NO: 334624 - DNA, 1192 bp, Homo sapiens
ttgtatggtttttaaagtcttgcagcgattcgttgctcaacgccgccatcacactccatacttctagaatttcccatgtcctactttgcaatgtaacccagagggtatcattctggtttgtggttacagacccttcaaaaaatcacacccttcctgctgttgaggtgcaatcagccataagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtagaagaaagaacaaagaaccatctgaagtggatgacgctgaagataagtgtgaaaacatgatcacaattgaaaatggcatcccctctgatcccctggacatgaagggagggcatattaatgatgccttcatgacagaggatgagaggctcacccctctctgaagggctgttgttctgcttcctcaagaaattaaacatttgtttctgtgtgactgctgagcatcctgaaataccaagagcagatcatatattttgtttcaccattcttcttttgtaataaattttgaatgtgcttgaaagtgaaaagcaatcaattatacccaccaacaccactgaaatcataagctattcacgactcaaaatattctaaaatatttttctgacagtatagtgtataaatgtggtcatgtggtatttgtagttattgatttaagcatttttagaaataagatcaggcatatgtatatattttcacacttcaaagacctaaggaaaaataaattttccagtggagaatacatataatatggtgtagaaatcattgaaaatggatcctttttgacgatcacttatatcactctgtatatgactaagtaaacaaaagtgagaagtaattattgtaaatggatggataaaaatggaattactcatatacagggtggaattttatcctgttatcacaccaacagttgattatatattttctgaatatcagcccctaataggacaattctatttgttgaccatttctacaatttgtaaaagtccaatctgtgctaacttaataaagtaataatcatctctttttgattgtgaaataa

SEQ ID NO: 334625 - DNA, 278 bp, Homo sapiens
cccaagtgtaaaggggcttccctgggagaccaaagccacctcctctttctcgcttcccaccacagcctcagcccctcgttcacacctcacaccgcagagaagccccgcaccgcatcccggctggcccatctgtggagttttaaagagccttccaatttcttcccgtgtttgatttaaccgaatcactaaaaatacatgcaaagcgatactccattattttcacactcaactcagaaaacgaccaggcgccacgatgcgccgttgagacaactagttgt

SEQ ID NO: 334626 - DNA, 1583 bp, Homo sapiens
aaaaaaaacaaattgagtggtgagaatacaacagaagtctgacttagactgagtgttgtcagcatgtgattacaatcacacggactctgaatcatttcactttctccataatgtcctttgaaacactgtttttaagtccaacttattttttctttggttgcttgtgcctaatccagggttatgaatatttacgactaagttttaagaattttatagttatatctcctacatttaggtctttgatccattttgagttaattttcatatatgatatgaaagagagatctgacttcgttcttctaacgtggctattcaattgtcagagcaccatttatggaaaggatttttttcccattgtcaaaaatcaactatagaggtatgggtttatttatagattcttaattgtattctaatgatctataatatcttcttatgccaataccacattgccttgatttctgttgctttgtaggaaattttgaaagcgagagtcctaagtttgttttttctaggttgttttggctattctaggtcccttgtatttccatatgaattgcaggatcagcttgtcaatttctatactaaaataaaggcagttgggattttcataagcgttgtattcatgacataaagcaaatgtggagaatattgccatattaagccttccagtccatgaacatgagatgtctttccatttattgggtttttaatgtcttttaacagtggattataatttttgctaagtctcatacttttgttagatttatttctaagtattgctactgtaaaaaaaatggaatttcctgtttttggattgtgtatataaatacaattgcttctgtatattgacaattgcatcatgcaacatcaaactttttcttttttgtggattccttaggattttctacattgaaggtcatgttgtttgcaaccagagatagtttgaactcttccttttcaatctggatgccttttctttctttctcctcccaaacggtcctggctagagccactagtacaatgcttattaggtggcaatagtggatatcgttgtcttctgatcttagggagaagctttctctcatcactaattatgatgctagctgtgggttttttattgataagctttatctggttgaggatgttgccttctgtatagtttgtcttttacaaaaatccaaatcccttccatgataaaaacactcaacaaacatacattgcatctactgaagtagtcatgtggtttttatcctttattctattaatatggtacattacactgattttcaaatgtttttgttttaagacagagttttgctctgtcacccatgctggaaggaagtggcgcagtcatggcttgctgcagcctcaacctcctgagctcaagccatcctcctacctcagtttctatagtagctgggcccacaggcacacaccaccatgccctgctaaatgttgtgtttttagtagagtcagggttttgccatgttgtccaggccagtctcaaactcctgggcttaagcaatccacccaccttggcctcccaaagtgctgaaattaagcatgtgccactgcacctggcc

SEQ ID NO: 334627 - DNA, 1367 bp, Homo sapiens
ggagatgagaaggtctaggtgtgcttgaggggatgggccaaaatggtgggaaattagcttggtaaggcagctcatgaagatcttcacaacagaagagtttggcaattattgattgagcaactggacaccctgactgaactcttttgccaatagttttatggtggaaaaacaaaacctcctcagctcctctttcactccttctcttctgcaaggaaaacgattttcagactagaaaggacaaggtgaacaccagagagaaactcctgaaggcagtctagttcaagagagccgtaagctgccttgagtaactgcatctcattgtctgagtcagtagcatcccagggcacttaaggacttgcagctcaaattgcaggacaactggtggtggccctgaaaaccccatgaagaagggaagagatacgtgctgcagcctagagatgggtaaacatggccccactttgacagatgggaaaaggtaaactccacaaattatagatcaatacatttgatattgattgagggcaagattctaggacaaatgattaaaaggatggttggtgagcacttacaaaaggaagcgacgatcactcagtccccacatggattcaggaaaaacaaatcatgccccactgggttcatttcccttgacagagtgactggacaggtagaggagggaaaagttatcacccacagcgtatctagagttcaaccaaacattctctcaatgcttttgggaaaacatgtatacatgtggggtgggtaaaggtaaacctaggcgaattcttaactggttgaatgactacatacaaaatagttctgttttaatgtcactagatcaaatttgcgaattacacaaagttggtaaagtcccttatttgaacttcaaaatgtggcagtacaaatgtaagatgtgagagatgtggcttagaggcattttagagtgaatgaaagctcatgagttgaaagtgtggtttggttgctgtaaaaagtattgtgaccttgggccatattactaagagtacaactttcagaacaaaggaggtgatcatcttgtgctactttgcactgatcagaccacatctgatgcccagtgttcagttatgagcaccagacttcaagggagatgttaacaaaagtatatccagagaagagtgagaagactgaagaatcccaggagaaatttgtctactgtcagtgagtaattactgggctcacagtagatttgttctgcgtgacttcagggctccaagatctaatggatggaaattataggaaagcagatttgggttcaacatgaggaagatgctccttttccttccttttttatgatgaaaaattataataaaagtttcagctcctgaaaacag

SEQ ID NO: 334628 - DNA, 3986 bp, Homo sapiens
ggtgcgcgggcacagcagccaggctgccggagagctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatgtaaagcggatttccaaggaatgcgcccgaaagcccaacaagaaaatttgtaggaaaggaggatccggcgctaagaaacagggcgaggacttagcggataatgacggggatgaagatgaagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacactaacggaaacccatggagtttgtcctttgtaaaaattttaaacacagtgtcttgatataaaaataaaaaatccagttagcactcccaaaaaaaa

SEQ ID NO: 334629 - DNA, 3926 bp, Homo sapiens
ggtgcgcgggcacagcagccaggctgccggagagctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatggatccggcgctaagaaacagggcgaggacttagcggataatgacggggatgaagatgaagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacactaacggaaacccatggagtttgtcctttgtaaaaattttaaacacagtgtcttgatataaaaataaaaaatccagttagcactcccaaaaaaaa

SEQ ID NO: 334630 - DNA, 3968 bp, Homo sapiens
ggtgcgcgggcacagcagccaggctgccggagagctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatgtaaagcggatttccaaggaatgcgcccgaaagcccaacaagaaaatttgtaggaaaggaggatccggcgctaagaaacagggcgaggacttagcggataatgacggggatgaagatgaagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtatattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacactaacggaaacccatggagtttgtcctttgtaaaaattttaaacacagtgtcttgatataaaaataaaaaatccagttagcactcccaaaaaaaa

SEQ ID NO: 334631 - DNA, 3866 bp, Homo sapiens
ggtgcgcgggcacagcagccaggctgccggagagctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatgacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacactaacggaaacccatggagtttgtcctttgtaaaaattttaaacacagtgtcttgatataaaaataaaaaatccagttagcactcccaaaaaaaa

SEQ ID NO: 334632 - DNA, 593 bp, Homo sapiens
  misc_feature (486)..(486): n is a, c, g, or t
tcaataacatatttaagtataatttcaattgttcagattattatattcttgtatttaatggtgagaggtattatttcccttttcaattttgtcatattgcaaatttcgaggaaaattaaagttatgtacgtctccagagatattatctagagatattaccaactgcgttttccaaaacgcaattggtaagagttttttttcccttgccttacactcaaggtagagaaataaattattttccaccattgaaaaaaaaaactgcacaaaagcttgtctggttcccaaaacaactgcttcttctaaaagttctcaatgattttcatagtataaatgctaaattacctcaacagaaatacaacacaagtttgaaggaaaccagaaaccaccataaatagcaactttcaaaagatgagagtacctgggcgccggtggctcacattatgctttcttaaagactgtctggaattacggcatttctattatttnagagtcaataacatatttaagtataatttcaattgttcagattattatattcttgtatttcatgatgagaggtatatttccctgctattgaaacttctaaaactagg

SEQ ID NO: 334633 - DNA, 1075 bp, Homo sapiens
gcacaggtcaagtatttcatgttgatttaaatactaagtcaatttatattgttaaatgatatattaatttcaggtaataatctccagatgagtaaggattagtaaattggttggtcatacacaatcagagatttaatagcatcatttgttgtttatgttgcaaaaaaaatattttgtagatgaagtagcttagttgaaaactctttttgtattttttttttttttttactgtttggagatagtgtagagatgtgaggaaaatttaaaaatgtgtgtgattttcttgaaataaattgcagtagaaatcaggtaacattttaagttttagtatcaaactggaataatatttgatgatatagcaatgtatatgtttttgaaagctataaaacttgaaacaacaggctggcaaagtctgttgagtaactgtcaataaatggattatgatagctagaatattgaaacatcagggctcagtactatttgaaagtacattcttctgtgaataaagaacaacccttgagccttacattttatcttttaaggggttgagcgggaaaaacaggacctggagaagcaaatgtcagatttgagagtgcagctgaacttcagcgcaatggcatctgagttagaggaagtgaaacggtgcatggagagaaaagacaaggagaaagcacatttggcatcacaagtagaggtgactttgctctttttaagtcatattcgaaatattttaattttatctcatggaattgcttaatgaaattttaatataaagatgtgttattttatgaactccagtgtgagcattgataatataaagttatattaatgactgatttacttatatgtagaaattcctatgggttcatttctctttcattcaggaccccaaagccaggaacctggatgattttcctttattattttacagagaaatcctttactatttttaaatttgaaaatatttttgttctaatagcaattgaaccctttctacagacagaagggaccttttttgtttgagagaacagtgaattattatttattttgcgggtgaaactggcagaatgcatag

SEQ ID NO: 334634 - DNA, 950 bp, Homo sapiens
acatgatagctggtgttactgagtaaatttgagtgttaaatgtcaatgtaagctaacggccaagatagggaccactgcagggtggttacttgcagctgtgactcaactggtccttcactgccaaacatacctggggttggatcattggcctgacgtttgcaaattgaggaaccttagggcaaatcagtgaacttctgaactgccttcgtcttcagttatatggggatttccccacttttgagatccttgtaaggattatatgagatgaagagatgagacaaggtatataaaagtcctagcacagagcgtgtcatataatatggcttcacaagtaccctcatctcctttccacctgggcgacagaatgagactccatctcaaaaaaaaaaaaaagaaaccaaggatatagaataaaacaagagtgtagatttgggcattgaggccttcaaattggattgttcccaatgtccagaagaaaaaaaaaatttagaagagacccaaatcagaaaacaaaagttgggctgaattcaatgcgaattattttctagctcaatattaatactgcttatgtcagctgaatttcagcctttcaataacagctagtcaagtatttttttagttggttcctattgatcgtcatcttattttagtggaatccattatattgaagatgtcaagttcctcatttcccatacaaagaatgtgagattcatctttcttgaatctttgctaagtgttgaaggggacttttggcatcttttcaggaggactataattgggccctctaactaaaaagtctcctatgccccttagatagatgagattttttttttgaccttgtacccaccaacattggtgggaggctcagaagggactgtgtttgtaactttgtagcactttctaaacagtgacctgttgtatgggcattataggacagtccgtggggtggg

SEQ ID NO: 334635 - DNA, 1464 bp, Homo sapiens
acatgatagctggtgttactgagtaaatttgagtgttaaatgtcaatgtaagctaacggccaagatagggaccactgcagggtggttacttgcagctgtgactcaactggtccttcactgccaaacatacctggggttggatcattggcctgacgtttgcaaattgaggaaccttagggcaaatcagtgaacttctgaactgccttcgtcttcagttatatggggatttccccacttttgagatccttgtaaggattatatgagatgaagagatgagacaaggtatataaaagtcctagcacagagcgtgtcatataatatggcttcacaagtaccctcatctcctttccagtcgttttttgttgttgtttttgtttttttgagaccatctcactctgttgcccaggctggagtgcctcttcatttttatttctttattcagcaagtattgatcaaatgtgctttgtaccaggtactgagctctacgttgggatataatggtgatcaaggagattgtagattctggcagggaaaactgacatcaaacacggcgacccgacatagtgagaccctgtctctactagaagaactttaaaaatcacctaggtgtgggccgggcacggtggctaacgcctgtaatcccagcactttgagatgctgaggcaggtggatcacgaggtcaggagatcgagaccatcctggataacacggagaaaccccgtctctactaaaaatacaaaaaaattagccgggcgtgggggcgggcatctgtagtcccaattactcgggaggctgcagcaggagaatggcatgaacccgggaggcggatcttgcattgagccaagatcacgccactgcactccagcctgggcgacagaatgagactccatctcaaaaaaaaaaaaaagaaaccaaggatatagaataaaacaagagtgtagatttgggcattgaggccttcaaattggattgttcccaatgtccagaagaaaaaaaaaatttagaagagacccaaatcagaaaacaaaagttgggctgaattcaatgcgaattattttctagctcaatattaatactgcttatgtcagctgaatttcagcctttcaataacagctagtcaagtatttttttagttggttcctattgatcgtcatcttattttagtggaatccattatattgaagatgtcaagttcctcatttcccatacaaagaatgtgagattcatctttcttgaatctttgctaagtgttgaaggggacttttggcatcttttcaggaggactataattgggccctctaactaaaaagtctcctatgccccttagatagatgagattttttttttgaccttgtacccaccaacattggtgggaggctcagaagggactgtgtttgtaactttgtagcactttctaaacagtgacctgttgtatgggcattataggacagtccgtggggtggg

SEQ ID NO: 334636 - DNA, 1581 bp, Homo sapiens
aggctgcaacacatgaaaacaggaaggagacacaggggcgagtcagctccactgaaagtctgtagctgtgactttctggtttgccactccaatttgagtactaattaagtggtagtcacatcttcaacataaaaaccaaaataatggcatcctcgtggaaggaattttgtcagaaaaatgctgtgtactttgctgtcttcctaggatttgttctgtttttgtttgtttgttttttttaatggttccacaggctgcataggaatacaagctaagcaatattttaattacagatcattaagcagctttgagtctggaaaatttgtcaaatgtaccgagcaattagaattgttaccaggagaaaatatcaatctacttgctggagggtcaaaagaaaaaatagacatgaaaaaactgcttcgtaacatgtgaagtccagatccaagggaacctcagaaatccattgaagttccattgttaagaagttctgtttgtttttttgagaccatctcactctgttgcccaggctggagtgcctcttcatttttatttctttattcagcaagtattgatcaaatgtgctttgtaccaggtactgagctctacgttgggatataatggtgatcaaggagattgtagattctggcagggaaaactgacatcaaacacggcgacccgacatagtgagaccctgtctctactagaagaactttaaaaatcacctaggtgtgggccgggcacggtggctaacgcctgtaatcccagcactttgagatgctgaggcaggtggatcacgaggtcaggagatcgagaccatcctggataacacggagaaaccccgtctctactaaaaatacaaaaaaattagccgggcgtgggggcgggcatctgtagtcccaattactcgggaggctgcagcaggagaatggcatgaacccgggaggcggatcttgcattgagccaagatcacgccactgcactccagcctgggcgacagaatgagactccatctcaaaaaaaaaaaaaagaaaccaaggatatagaataaaacaagagtgtagatttgggcattgaggccttcaaattggattgttcccaatgtccagaagaaaaaaaaaatttagaagagacccaaatcagaaaacaaaagttgggctgaattcaatgcgaattattttctagctcaatattaatactgcttatgtcagctgaatttcagcctttcaataacagctagtcaagtatttttttagttggttcctattgatcgtcatcttattttagtggaatccattatattgaagatgtcaagttcctcatttcccatacaaagaatgtgagattcatctttcttgaatctttgctaagtgttgaaggggacttttggcatcttttcaggaggactataattgggccctctaactaaaaagtctcctatgccccttagatagatgagattttttttttgaccttgtacccaccaacattggtgggaggctcagaagggactgtgtttgtaactttgtagcactttctaaacagtgacctgttgtatgggcattataggacagtccgtggggtggg

SEQ ID NO: 334637 - DNA, 634 bp, Homo sapiens
tcaggtttgaaaaggcctctgtggagtaccaggaacacctgtgtgccatgataggtgttcattgctgcatctccagctttgacaaatcggtgctcaccttagccaatgctgggtgtaacagtgccagcccgaaacattgtctgaatggtgaatccagaaaaactgtgctgtccaaaccgactgactcttcccctgaggttataaattatttaggaaataaagcatgtgagtgctacatctcaattgccgattgggctgctgtgcaggaatggcagaacgctatccatgacttgaaaaagagtaccagtagcacttccttcaacctgaaagctgacttcaactatataaaatcattaagcagctttgagtctggaaaatttgtcaaatgtaccgagcaattagaattgttaccaggagaaaatatcaatctacttgctggagggtcaaaagaaaaaatagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaaac

SEQ ID NO: 334638 - DNA, 393 bp, Homo sapiens
tgctgggattacaggcgtgagccaccacacctgacctcgacttagtgatttttgagcctttgaaggcaactgctttttaggggtctgaggtacagtaattttgtatgaagtatgatttttatatagctctcagtaatgcttatagtgtttaactgcctgaaatattaaaggagctgttcattggtgattagttcttaataatgccaaacataaatcaaaatttataataaaagcacattaacttaatgacatttcatttaacttctgtagacatgaaaaaactgcttcgtaacatgtgaagtccagatccaagggaacctcagaaatccattgaagttccattgttaagaagttctgtttgtttggcaactgctttaaacccgatagaacaag

SEQ ID NO: 334639 - DNA, 1640 bp, Homo sapiens
tcaggtttgaaaaggcctctgtggagtaccaggaacacctgtgtgccatgataggtgttcattgctgcatctccagctttgacaaatcggtgctcaccttagccaatgctgggtgtaacagtgccagcccgaaacattgtctgaatggtgaatccagaaaaactgtgctgtccaaaccgactgactcttcccctgaggttataaattatttaggaaataaagcatgtgagtgctacatctcaattgccgattgggctgctgtgcaggaatggcagaacgctatccatgacttgaaaaagagtaccagtagcacttccttcaacctgaaagctgacttcaactatataaaatcattaagcagctttgagtctggaaaatttgtcaaatgtaccgagcaattagaattgttaccaggagaaaatatcaatctacttgctggagggtcaaaagaaaaaatagacatgaaaaaactgcttcgtaacatgtgaagtccagatccaagggaacctcagaaatccattgaagttccattgttaagaagttctgtttgtttttttgagaccatctcactctgttgcccaggctggagtgcctcttcatttttatttctttattcagcaagtattgatcaaatgtgctttgtaccaggtactgagctctacgttgggatataatggtgatcaaggagattgtagattctggcagggaaaactgacatcaaacacggcgacccgacatagtgagaccctgtctctactagaagaactttaaaaatcacctaggtgtgggccgggcacggtggctaacgcctgtaatcccagcactttgagatgctgaggcaggtggatcacgaggtcaggagatcgagaccatcctggataacacggagaaaccccgtctctactaaaaatacaaaaaaattagccgggcgtgggggcgggcatctgtagtcccaattactcgggaggctgcagcaggagaatggcatgaacccgggaggcggatcttgcattgagccaagatcacgccactgcactccagcctgggcgacagaatgagactccatctcaaaaaaaaaaaaaagaaaccaaggatatagaataaaacaagagtgtagatttgggcattgaggccttcaaattggattgttcccaatgtccagaagaaaaaaaaaatttagaagagacccaaatcagaaaacaaaagttgggctgaattcaatgcgaattattttctagctcaatattaatactgcttatgtcagctgaatttcagcctttcaataacagctagtcaagtatttttttagttggttcctattgatcgtcatcttattttagtggaatccattatattgaagatgtcaagttcctcatttcccatacaaagaatgtgagattcatctttcttgaatctttgctaagtgttgaaggggacttttggcatcttttcaggaggactataattgggccctctaactaaaaagtctcctatgccccttagatagatgagattttttttttgaccttgtacccaccaacattggtgggaggctcagaagggactgtgtttgtaactttgtagcactttctaaacagtgacctgttgtatgggcattataggacagtccgtggggtggg

SEQ ID NO: 334640 - DNA, 253 bp, Homo sapiens
aagccagggctgggtgagatgaggctcagcctgagggagttcatcaggaccggagggctgcttgcggcccatctcaacaaggactcctcactgctcggtgtcgtgcaggtgtgccactgcgagccgggtgggcagcccagccccataggtcgtaggcagagagtatgcatggcccacatgcagtaccttctcatatgatacaacagccctgtgatggtgccatttacatttttttgaatgaagaaactgaggc

SEQ ID NO: 334641 - DNA, 231 bp, Homo sapiens
atatttgaaacttcctaattatttctgaaaatatcttttaaagctatttgattgaaccagaatctgaacaagttcagtcattgtatttggttctatctctttagtctcttaatacagaaaagctttggcccaccttttttttgtgtgtgttttgtgaacattcacttttttttttgttgagtcagagtctcgctctgtcgcccaggctggagtgcagtggtgccgtctcgg

SEQ ID NO: 334642 - DNA, 444 bp, Homo sapiens
tcttctctaaatttttacacttacatctacaatgaacttggaattgattttttcatttccaaaagagttttacaattaatcaagtatcacaggctaatttcactcaagaactcagatgcaaaagtccaaaccaagtatcagtcaacctaatccagcaatatataaagcgatattatgaccaagttggatttcaggaatgcaagtgtagttgatcatttcaaactcaatcactgcaatttctcatactgatgtatcaatggagacaaagtatagaggtacttttttaatgttttatgagaaatgctaagctgaatttatgtcaaggaagaactgaggccatatatagtggctcacacctgtaatcccagcagggccaaggcaggcggattgcttgaggccaggagtccaagaccagcctggccaatgtagcaaagaccccaaaag

SEQ ID NO: 334643 - DNA, 170 bp, Homo sapiens
gctctgatcagcaagaagcttaatgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaa

SEQ ID NO: 334644 - DNA, 383 bp, Homo sapiens
gaaatagtacaggaaaataagtctgtcttggttctcaccacctagtggggagtaaacaaatgcaatagaaggcctgtctcaagggtcttgagagaaagttgcttagggagctgtgggaactcacaaaggggaccacctaactcagcctggagatttccagaaagtcttgccagagaaggcgtcacttagctcagatgttaaaggatgagcaagaattagctagagaaataagaaaaggaaaagtattccagtcagagaaatcagcatatgccaaggcacagaggtatgctgtgtttgggaaaagcaggagtgctgggtggctggaggcttgtagcagtcattgagaagccagatattcaaggttccttgatggcctactcgta

SEQ ID NO: 334645 - DNA, 247 bp, Homo sapiens
aaatcggtagactttttctccacaagtcctgtcagagtcagcagctttctgcagtaccgaaggccacttcctcacggtccccaagctcctgagggaggcagaggctcccacaagtgacagtgggcaccccctccccaaaatgcaaaacaaaagcaactcccacaggcccgccgccaccaccccttgctttccccggaaatcgaaggaaaatctctagtgtccccaacgcctcgtggtggccctgctc

SEQ ID NO: 334646 - DNA, 476 bp, Homo sapiens
tgcctggcacacagggagagcggcgagggggaggccagggaggccagggtcagaaggtcaagactagaaggagtttaaagaacagagccctagggagcatcaaagagccaactacggaggctccaagggaaggagccaactgggagacaggtcgtggatcatgggagagggtagaaagtgtgcttgcagcagccctgatgctcagagaggaaggcaaggagccaggggacaagcagtcagtgggggctgttagggagaaggaagcctcattgtctgtgtcacaggtggtggtcaggtggctgatgtgacggcagagaacagttatgccaggagttgtaagtggcagcaggtgccagatcagcagcttgcaggagggctatggcttaagcagaaatgcaaacctgttagtattgttaaaaagcaagagtgactttagtattcatgaacagtaaatcagaggtcagacttgacaagag

SEQ ID NO: 334647 - DNA, 435 bp, Homo sapiens
gggaattgcttgagtccaggagtcggaggtcgcagtgagctgagatcatggcactgcactccagtctggtgatagaacaagactgcctcaaaacaaacaaacaaaaatttggagcttatgtttaaggaagatttatttaaaacacacaaaatatcaagtatttggggaggatgtggaacaattagaactccctttgactcctggaaggagtgttaactggtacaaccacttggcggcactgggagactctactaaagctgaacatatgtgttatggaatgaattgtgtccactccccgcaaaattcttatgttgaaatcctaacccccacagggtctcgctctgtccaccatgcctggctaattaaaaaaaagttttttttttggagacagagtttcacggtgtgggccaggagggtctggatctcctaacctcg

SEQ ID NO: 334648 - DNA, 407 bp, Homo sapiens
cacttgctatgttatctccctcacactcatattcaccctgatgctccccactccccactcaccatgagacagttttaaaagaattgaccctaaagagttcgccatctcctctcatccttccccaaccctctccaatcagctgttgcccctaggtatccccaggcatcttcttaatgactagttgtctctgtgttgccaaacccaacactcagttccaatgcttgtctgccttgacacatcagtgtcatgtttggacagtgagtccctgcctccctgtgaagcacgttcctctcttggcttcctggactgctctctctgtcatcctgattcactggctgctctttctctgcacctatgtatttttctcctcaacttccctcctgtaaacccaggagttccccaggcct

SEQ ID NO: 334649 - DNA, 449 bp, Homo sapiens
aaaaaaaaaaaaaaagaataaaatgctatctctatgttcagattgaaattgaaggtaaagaataaaagaaagaaaaaagaaatccatactggtcctagttttttttaaaagagcctgcctataatagcatccaaattgaggcaaggcagattagatacattcttacaatcctaaaccagaaagcagtttataaatttaacaagatattaatgataccttcattgctgtagtgatggatatgtgtgtgcaaatagtttaccttcaaggtaagtggattcttgaaggtatgaatgttgaatttctgcactccgattggaaccatgtaattgggttggcattaccacaactatttttctagtaatctttaagtatttctttcattgataaatagaaataaaagtatatagtaagtttggcatttgttttaaacttttgggtattgactgata

SEQ ID NO: 334650 - DNA, 845 bp, Homo sapiens
ctgaagccccacggtgttttcccccttaagcccaagatatttaggaccccccctggtttggggctcagcttgttgagtccttccagtcacgggtcttccaagtttataagaagaatcagatttccaagagcaatttacccctttcttcattctgttaggcattatttggaatggcttttcttcgatgaattcaattaacaggctggagtgcagcggcgtgatctcggctcactacaacctccacctcccgggttcaagcgattcttctgcttcagccttctcctgagcagctgggattacaagtgcgcaccatcatgcctggctaatttttgtatttttaatagagacggggtttctccatgttggccaggctcgtctcaaactcctgacctcaggtgatctgcccacctcggcctcccgaagtgctgggattacaggtgtgagccactgcacccagcctaaagagaatattttctcaattaaaaatactatagtcttcagaaaagaatcaattaaagtgatgagaaatttcaaatatattaactacaaactgcaactttgaaaaatattgcaggcaattttattaagttctacagagaaatgtcagtaacatggtattagaaataaatatagctgataaacagattaaagtttatgaatatataccaagaataattattctgcttatgtaattttaattttggaaaaccattttgaaaagtttgttacatgaaatgttatttttaaaagaatttcatatttgaaaatagtttgaatatataatttttaagtattttcaatgcaattagtccaattttctgatcaataaatatcttttaaaagta

SEQ ID NO: 334651 - DNA, 696 bp, Homo sapiens
aaatgtatgatgaaagtgagccgcccccacccatcaatactctcagctggcagctggagtgcagcggcgtgatctcggctcactacaacctccacctcccgggttcaagcgattcttctgcttcagccttctcctgagcagctgggattacaagtgcgcaccatcatgcctggctaatttttgtatttttaatagagacggggtttctccatgttggccaggctcgtctcaaactcctgacctcaggtgatctgcccacctcggcctcccgaagtgctgggattacaggtgtgagccactgcacccagcctaaagagaatattttctcaattaaaaatactatagtcttcagaaaagaatcaattaaagtgatgagaaatttcaaatatattaactacaaactgcaactttgaaaaatattgcaggcaattttattaagttctacagagaaatgtcagtaacatggtattagaaataaatatagctgataaacagattaaagtttatgaatatataccaagaataattattctgcttatgtaattttaattttggaaaaccattttgaaaagtttgttacatgaaatgttatttttaaaagaatttcatatttgaaaatagtttgaatatataatttttaagtattttcaatgcaattagtccaattttctgatcaataaatatcttttaaaagta

SEQ ID NO: 334652 - DNA, 867 bp, Homo sapiens
  misc_feature (702)..(702): n is a, c, g, or t
  misc_feature (751)..(751): n is a, c, g, or t
  misc_feature (865)..(865): n is a, c, g, or t
  misc_feature (867)..(867): n is a, c, g, or t
aaatgtatgatgaaagtgagccgcccccacccatcaatactctcagctggcagctggagtgcagcggcgtgatctcggctcactacaacctccacctcccgggttcaagcgattcttctgcttcagccttctcctgagcagctgggattacaagtgcgcaccatcatgcctggctaatttttgtatttttaatagagacggggtttctccatgttggccaggctcgtctcaaactcctgacctcaggtgatctgcccacctcggcctcccgaagtgctgggattacaggtgtgagccactgcacccagcctaaagagaatattttctcaattaaaaatactatagtcttcagaaaagaatcaattaaagtgatgagaaatttcaaatatattaactacaaactgcaactttgaaaaatattgcaggcaattttattaagttctacagagaaatgtcagtaacatggtattagaaataaatatagctgataaacagattaaagtttatgaatatataccaagaataattattctgcttatgtaattttaattttggaaaaccattttgaaaagtttgttacatgaaatgttatttttaaaagaatttcatatttgaaaatagtttgaatatataatttttaagtattttcaatgcaattagtccaattttctgatcaataaatatcttttaaaagtaaaaaanaaacaaagaaccgccctcgttgggctcaaacggggatctttgacgccgnttaccctttagtggggtgtaatccatgatcctcgttccatgactccgctcaccaatgtcgttcggctgcggcaacgggtccagcatattcaaaggcgggattcgtgttgatccncn

SEQ ID NO: 334653 - DNA, 867 bp, Homo sapiens
  misc_feature (758)..(758): n is a, c, g, or t
  misc_feature (792)..(792): n is a, c, g, or t
ttatgtaaagttttttcgggtgtcatgaatttcagattaatcttgggctgacagctggagtgcagcggcgtgatctcggctcactacaacctccacctcccgggttcaagcgattcttctgcttcagccttctcctgagcagctgggattacaagtgcgcaccatcatgcctggctaatttttgtatttttaatagagacggggtttctccatgttggccaggctcgtctcaaactcctgacctcaggtgatctgcccacctcggcctcccgaagtgctgggattacaggtgtgagccactgcacccagcctaaagagaatattttctcaattaaaaatactatagtcttcagaaaagaatcaattaaagtgatgagaaatttcaaatatattaactacaaactgcaactttgaaaaatattgcaggcaattttattaagttctacagagaaatgtcagtaacatggtattagaaataaatatagctgataaacagattaaagtttatgaatatataccaagaataattattctgcttatgtaattttaattttggaaaaccattttgaaaagtttgttacatgaaatgttatttttaaaagaatttcatatttgaaaatagtttgaatatataatttttaagtattttcaatgcaattagtccaattttctgatcaataaatatcttttaaaagtagaggagcacgatcagagcacgccagagcatcggagctcataagttattaagcactaatatncaatatacaaaggcatgccctatggaatataagnaatcgtggcctttcggctcctcgggggcctctccccgtcgtccctctttacgggggtatcgttgatctgctccct

SEQ ID NO: 334654 - DNA, 827 bp, Homo sapiens
  misc_feature (1)..(1): n is a, c, g, or t
ngcttcctgaccctttttaatccaattttgatttcacccttaataaagccgagtttattttcacagctcagcatgcgcttcggagccgcaaagcccaggcttgaataatcgcttcccatagggcccaggtgttgggactttgatgggaaaaaggtgaagcaaaatgtggtaaacaggaatgaaaagccagaatgaataaaggaagccttcattgttctgaggatgggatctccttatgttgctcaggctggtttcagacttctcctgagcagctgggattacaagtgcgcaccatcatgcctggctaatttttgtatttttaatagagacggggtttctccatgttggccaggctcgtctcaaactcctgacctcaggtgatctgcccacctcggcctcccgaagtgctgggattacaggtgtgagccactgcacccagcctaaagagaatattttctcaattaaaaatactatagtcttcagaaaagaatcaattaaagtgatgagaaatttcaaatatattaactacaaactgcaactttgaaaaatattgcaggcaattttattaagttctacagagaaatgtcagtaacatggtattagaaataaatatagctgataaacagattaaagtttatgaatatataccaagaataattattctgcttatgtaattttaattttggaaaaccattttgaaaagtttgttacatgaaatgttatttttaaaagaatttcatatttgaaaatagtttgaatatataatttttaagtattttcaatgcaattagtccaattttctgatcaataaatatcttttaaaagta

SEQ ID NO: 334655 - DNA, 848 bp, Homo sapiens
  misc_feature (1)..(1): n is a, c, g, or t
ngcttcctgaccctttttaatccaattttgatttcacccttaataaagccgagtttattttcacagctcagcatgcgcttcggagccgcaaagcccaggcttgaataatcgcttcccatagggcccaggtgttgggactttgatgggaaaaaggtgaagcaaaatgtggtaaacaggaatgaaaagccagaatgaataaaggaagccttcattgttctgactggggcctgagcagtgagcagaatggaatgtctatcaggacagccgtagatttccacagcttcctgctttcgtcagcttcagcttaacatctattattgtgaagagtagggtcttccaagtttataagaagaatcagatttccaagagcaatttacccctttcttcattctgttaggcattatttggaatggcttttcttcgatgaattcaattaacaggtgtgagccactgcacccagcctaaagagaatattttctcaattaaaaatactatagtcttcagaaaagaatcaattaaagtgatgagaaatttcaaatatattaactacaaactgcaactttgaaaaatattgcaggcaattttattaagttctacagagaaatgtcagtaacatggtattagaaataaatatagctgataaacagattaaagtttatgaatatataccaagaataattattctgcttatgtaattttaattttggaaaaccattttgaaaagtttgttacatgaaatgttatttttaaaagaatttcatatttgaaaatagtttgaatatataatttttaagtattttcaatgcaattagtccaattttctgatcaataaatatcttttaaaagta

SEQ ID NO: 334656 - DNA, 988 bp, Homo sapiens
  misc_feature (988)..(988): n is a, c, g, or t
ctgaagccccacggtgttttcccccttaagcccaagatatttaggaccccccctggtttggggctcagcttgttgagtccttccagtcacgggtcttccaagtttataagaagaatcagatttccaagagcaatttacccctttcttcattctgttaggcattatttggaatggcttttcttcgatgaattcaattaacaggctggagtgcagcggcgtgatctcggctcactacaacctccacctcccgggttcaagcgattcttctgcttcagccttctcctgagcagctgggattacaagtgcgcaccatcatgcctggctaatttttgtatttttaatagagacggggtttctccatgttggccaggctcgtctcaaactcctgacctcaggtgatctgcccacctcggcctcccgaagtgctgggattacaggtgtgagccactgcacccagcctaaagagaatattttctcaattaaaaatactatagtcttcagaaaagaatcaattaaagtgatgagaaatttcaaatatattaactacaaactgcaactttgaaaaatattgcaggcaattttattaagttctacagagaaatgtcagtaacatggtattagaaataaatatagctgataaacagattaaagtttatgaatatataccaagaataattattctgcttatgtaattttaattttggaaaaccattttgaaaagtttgttacatgaaatgttatttttaaaagaatttcatatttgaaaatagtttgaatatataatttttaagtattttcaatgcaattagtccaattttctgatcaataaatatcttttaaaagtacaaacgcctaatccaaccaccaactggccccgccggcctcagccgtggaacctctgccggccgtttccctttaggggaggggtaatgtcaagatcccaggttcactgactccctgtgcttcgacggccggttgctgggagcan

SEQ ID NO: 334657 - DNA, 1022 bp, Homo sapiens
ctgaagccccacggtgttttcccccttaagcccaagatatttaggaccccccctggtttggggctcagcttgttgagtccttccagtcacgggtcttccaagtttataagaagaatcagatttccaagagcaatttacccctttcttcattctgttaggcattatttggaatggcttttcttcgatgaattcaattaacaggctggagtgcagcggcgtgatctcggctcactacaacctccacctcccgggttcaagcgattcttctgcttcagccttctcctgagcagctgggattacaagtgcgcaccatcatgcctggctaatttttgtatttttaatagagacggggtttctccatgttggccaggctcgtctcaaactcctgacctcaggtgatctgcccacctcggcctcccgaagtgctgggattacaggtgtgagccactgcacccagcctaaagagaatattttctcaattaaaaatactatagtcttcagaaaagaatcaattaaagtgatgagaaatttcaaatatattaactacaaactgcaactttgaaaaatattgcaggcaattttattaagttctacagagaaatgtcagtaacatggtattagaaataaatatagctgataaacagattaaagtttatgaatatataccaagaataattattctgcttatgtaattttaattttggaaaaccattttgaaaagtttgttacatgaaatgttatttttaaaagaatttcatatttgaaaatagtttgaatatataatttttaagtattttcaatgcaattagtccaattggtgcgagccatcagaagccttgtcacaagtgtacagaaaaaaagagaaaggggcctcgttgggccccagcggggggacctttggggccgtctaccctgtaaggggggggtgaatcaatgaaccccccctgcctgacttgcggcggcgggtacgtcgcggtggcgccaggcggattacgtgcttcagggggggactcggtgcgcac

SEQ ID NO: 334658 - DNA, 975 bp, Homo sapiens
ctgaagccccacggtgttttcccccttaagcccaagatatttaggaccccccctggtttggggctcagcttgttgagtccttccagtcacgggtcttccaagtttataagaagaatcagatttccaagagcaatttacccctttcttcattctgttaggcattatttggaatggcttttcttcgatgaattcaattaacaggctggagtgcagcggcgtgatctcggctcactacaacctccacctcccgggttcaagcgattcttctgcttcagccttctcctgagcagctgggattacaagtgcgcaccatcatgcctggctaatttttgtatttttaatagagacggggtttctccatgttggccaggctcgtctcaaactcctgacctcaggtgatctgcccacctcggcctcccgaagtgctgggattacaggtgtgagccactgcacccagcctaaagagaatattttctcaattaaaaatactatagtcttcagaaaagaatcaattaaagtgatgagaaatttcaaatatattaactacaaactgcaactttgaaaaatattgcaggcaattttattaagttctacagagaaatgtcagtaacatggtattagaaataaatatagctgataaacagattaaagtttatgaatatataccaagaataattattctgcttatgtaattttaattttggaaaaccattttgaaaagtttgttacatgaaatgttatttttaaaagaatttcatatttgaaaatagtttgaatatataatttttaagtattttcaatgcaattagtccaattttctgatcaataaatatcttttaaaagtagcgaagagagccaagacaacgagggtagcgtgcacgttgttaacgaagcccatacggggtgaggtagaccgaccatacgcttcacctgagccgcctgcccgttgtgtctttgggggaaaaaaacggcggt

SEQ ID NO: 334659 - DNA, 994 bp, Homo sapiens
ctgaagccccacggtgttttcccccttaagcccaagatatttaggaccccccctggtttggggctcagcttgttgagtccttccagtcacgggtcttccaagtttataagaagaatcagatttccaagagcaatttacccctttcttcattctgttaggcattatttggaatggcttttcttcgatgaattcaattaacaggctggagtgcagcggcgtgatctcggctcactacaacctccacctcccgggttcaagcgattcttctgcttcagccttctcctgagcagctgggattacaagtgcgcaccatcatgcctggctaatttttgtatttttaatagagacggggtttctccatgttggccaggctcgtctcaaactcctgacctcaggtgatctgcccacctcggcctcccgaagtgctgggattacaggtgtgagccactgcacccagcctaaagagaatattttctcaattaaaaatactatagtcttcagaaaagaatcaattaaagtgatgagaaatttcaaatatattaactacaaactgcaactttgaaaaatattgcaggcaattttattaagttctacagagaaatgtcagtaacatggtattagaaataaatatagctgataaacagattaaagtttatgaatatataccaagaataattattctgcttatgtaattttaattttggaaaaccattttgaaaagtttgttacatgaaatgttatttttaaaagaatttcatatttgaaaatagtttgaatatataatttttaagtattttcaatgcaattagtccaattttctgatcaataaatatcttttaaaagtacaggttacccctagcataattaaaattatgggaatgggctcgttggccatagagggggaagtttgcgggcgcttccttttacggagggtaatttatgatcctcgtccactacctcccacgctatgtcgttcagttgcggtaaccgtata

SEQ ID NO: 334660 - DNA, 971 bp, Homo sapiens
ctgaagccccacggtgttttcccccttaagcccaagatatttaggaccccccctggtttggggctcagcttgttgagtccttccagtcacgggtcttccaagtttataagaagaatcagatttccaagagcaatttacccctttcttcattctgttaggcattatttggaatggcttttcttcgatgaattcaattaacaggctggagtgcagcggcgtgatctcggctcactacaacctccacctcccgggttcaagcgattcttctgcttcagccttctcctgagcagctgggattacaagtgcgcaccatcatgcctggctaatttttgtatttttaatagagacggggtttctccatgttggccaggctcgtctcaaactcctgacctcaggtgatctgcccacctcggcctcccgaagtgctgggattacaggtgtgagccactgcacccagcctaaagagaatattttctcaattaaaaatactatagtcttcagaaaagaatcaattaaagtgatgagaaatttcaaatatattaactacaaactgcaactttgaaaaatattgcaggcaattttattaagttctacagagaaatgtcagtaacatggtattagaaataaatatagctgataaacagattaaagtttatgaatatataccaagaataattattctgcttatgtaattttaattttggaaaaccattttgaaaagtttgttacatgaaatgttatttttaaaagaatttcatatttgaaaatagtttgaatatataatttttaagtattttcaatgcaattagtccaattttctgatcaataaatatcttttaaaagtagggaacacagctacgaactctcggttctctcccgcaccacctctcaaaactggccttgtggccccaaagggggacctcttggggccttttcctttgggagggtaatccaagaacctcctcctgact

SEQ ID NO: 334661 - DNA, 907 bp, Homo sapiens
  misc_feature (1)..(1): n is a, c, g, or t
ngcttcctgaccctttttaatccaattttgatttcacccttaataaagccgagtttattttcacagctcagcatgcgcttcggagccgcaaagcccaggcttgaataatcgcttcccatagggcccaggtgttgggactttgatgggaaaaaggtgaagcaaaatgtggtaaacaggaatgaaaagccagaatgaataaaggaagccttcattgttctgactggggcctgagcagtgagcagaatggaatgtctatcaggacagccgtagatttccacagcttcctgctttcgtcagcttcagcttaacatctattattgtgaagagtagggtcttccaagtttataagaagaatcagatttccaagagcaatttacccctttcttcattctgttaggcattatttggaatggcttttcttcgatgaattcaattaacagaggtgggagccacctgccccccaacctaaaaagaaatatttttctaaaataaaaataactataggccttaaaaaaaagaatacacattgaaaggggaggaaaaaattttcaaaatatattaacctaccaacctgcgaacttttagaaaaaaattgtgggggggcaattttttatttaattgcctaacagaagaaaaaggccggggaacagtgggtatataaaaaaataaaataacctagtaaaaacaagtagaagttttgttaaatattgtaccaaagaaaaaagttttcgcggctggggagaagtttaaaacggcggaaaaacccacctttagaaaagagttgttcacatgagacagtttttttataaaaaaatgttctcaatggaagaaaaggggaggataaataaattctaaaggagttatcaaagcgaagtaggccaggcttttggagagataaaatcctttt

SEQ ID NO: 334662 - DNA, 938 bp, Homo sapiens
ctgaagccccacggtgttttcccccttaagcccaagatatttaggaccccccctggtttggggctcagcttgttgagtccttccagtcacgggtcttccaagtttataagaagaatcagatttccaagagcaatttacccctttcttcattctgttaggcattatttggaatggcttttcttcgatgaattcaattaacaggctggagtgcagcggcgtgatctcggctcactacaacctccacctcccgggttcaagcgattcttctgcttcagccttctcctgagcagctgggattacaagtgcgcaccatcatgcctggctaatttttgtatttttaatagagacggggtttctccatgttggccaggctcgtctcaaactcctgacctcaggtgatctgcccacctcggcctcccgaagtgctgggattacaggtgtgagccactgcacccagcctaaagagaatattttctcaattaaaaatactatagtcttcagaaaagaatcaattaaagtgatgagaaatttcaaatatattaactacaaactgcaactttgaaaaatattgcaggcaattttattaagttctacagagaaatgtcagtaacatggtattagaaataaatatagctgataaacagattaaagtttatgaatatataccaagaataattattctgcttatgtaattttaattttggaaaaccattttgaaaagtttgttacatgaaatgttatttttaaaagaatttcatatttgaaaatagtttgaatatataatttttaagtattttcaatgcaattagtccaattcgtgtcaccgaaatacttctacaattcccgaacaaaaagatcggcctgccggccgcaacggacgagcttgggcgtgcttacctttggcggggccacccacgtcccccctgattacaaaacgt

SEQ ID NO: 334663 - DNA, 943 bp, Homo sapiens
ctgaagccccacggtgttttcccccttaagcccaagatatttaggaccccccctggtttggggctcagcttgttgagtccttccagtcacgggtcttccaagtttataagaagaatcagatttccaagagcaatttacccctttcttcattctgttaggcattatttggaatggcttttcttcgatgaattcaattaacaggctggagtgcagcggcgtgatctcggctcactacaacctccacctcccgggttcaagcgattcttctgcttcagccttctcctgagcagctgggattacaagtgcgcaccatcatgcctggctaatttttgtatttttaatagagacggggtttctccatgttggccaggctcgtctcaaactcctgacctcaggtgatctgcccacctcggcctcccgaagtgctgggattacaggtgtgagccactgcacccagcctaaagagaatattttctcaattaaaaatactatagtcttcagaaaagaatcaattaaagtgatgagaaatttcaaatatattaactacaaactgcaactttgaaaaatattgcaggcaattttattaagttctacagagaaatgtcagtaacatggtattagaaataaatatagctgataaacagattaaagtttatgaatatataccaagaataattattccgcccacggcttttcgatgttggtacaccctttcgtccccttgctccctgacctgcctgtttaattaatgcttcctttccgatccctcgttgtttccttttttccctcgccaccctcctctccccctttctcatcactcctccccgttatcatttttcaccctttgtgacataatgttgtctcagcatccagtttcgcctctacacacttcccattgcgctggtgcgcgttacgatcttccctccgcctacgctttacacat

SEQ ID NO: 334664 - DNA, 607 bp, Homo sapiens
  misc_feature (1)..(1): n is a, c, g, or t
ngcttcctgaccctttttaatccaattttgatttcacccttaataaagccgagtttattttcacagctcagcatgcgcttcggagccgcaaagcccaggcttgaataatcgcttcccatagggcccaggtgttgggactttgatgggaaaaaggtgaagcaaaatgtggtaaacaggaatgaaaagccagaatgaataaaggaagccttcattgttctgactaaagagaatattttctcaattaaaaatactatagtcttcagaaaagaatcaattaaagtgatgagaaatttcaaatatattaactacaaactgcaactttgaaaaatattgcaggcaattttattaagttctacagagaaatgtcagtaacatggtattagaaataaatatagctgataaacagattaaagtttatgaatatataccaagaataattattctgcttatgtaattttaattttggaaaaccattttgaaaagtttgttacatgaaatgttatttttaaaagaatttcatatttgaaaatagtttgaatatataatttttaagtattttcaatgcaattagtccaattttctgatcaataaatatcttttaaaagta

SEQ ID NO: 334665 - DNA, 412 bp, Homo sapiens
attcctggggggggggttgcttgtgtgttccacccattgatacagatgggcaaagacaagtgattctgattccaagatggatttggaaaggtatgtctactggggaaaaatgcccaaatgacctgctaattggtttcctggctaattcaccttctggctttcatagaggggcaggttggaaatcagaatgactctaaattagccaaggtttctcagtgtgattgtagacttcatagactggctgacgggccccagagcccctgggtgagttattcttagggcaattccctgatggtcctgctcatagattttgtactgacaagttgggccaatggcattgctaagataaaaggggaaaattaaaacatgcccctgggatttccacacatgggatgaggcagggtgagctcag

SEQ ID NO: 334666 - DNA, 676 bp, Homo sapiens
ttcagctcgctgggtctcattttccccatctatagaatggggataatgttagtacagacctcatgtgactactgtgaggaaccagagagttaaagaagggtggctgggtgcggtggctcatgcctgtaatcccagcactttggaaggctgaggcaggtggattacttgaggtcaggagttcgagaccagcctggccaacatggtgaaaccctgtccctactaaaaatagccaggcatggtggtgggtgcctgtagtcccagctactcaggaggctgaggcaggagaatcacttgaacccgggaggtggaggttgcagagagccaaaatcgtgccattgtactccaacctgtgcaacagagcgagactctatctcaaaaaaaaagagaagggaaggaccccagtgtggtgcctggcattgtgggtactcaggataccctaaccattaggatgccctggtttgggctgcctcaaatctgcctctctttcctggcttcaggccctgccatcctaatgggaccaacctcacaccccagttccaggcctggccaatcaacactaactccaggtgctggtaggagatgggtcacctgacccaagcccagtcatcaaatcaatgaacgccagcccggggatctgaaggaaggaggcgctctcctccgatagtggggggaaagc

SEQ ID NO: 334667 - DNA, 419 bp, Homo sapiens
tttatcagaactctgaaaactaactaaaggcttgcaataatctcaggagtgtgattttaagaataacagccaaataacagtaaaaacagcaagctttgtggaattttaattttctctattcttatcatccccttgccaactccgtggtatccttacaagtcaacaatctcacaactatggctgctgtgaaaactagcagcctagcagttactagacagggcagaatgggtctggagcacctctaaaacccaatcgcaaagaaatgtcactttatgacctgtgtagcagctccctgaaaagctccattcccagagctcatctttccttttttttttttttttgagacccagagtctcactctgttgcccagactggagcgcagtggtgcaatctcggctcactgcaacctctgcctaccg

SEQ ID NO: 334668 - DNA, 433 bp, Homo sapiens
tgatcctcccacctcagcctttcacatagctgggactataggtgcaccatcacacctggctaatttttaatctttttctagagacagggtctcaatatgttgctcaggctggtcttgaactcttgggctcaagcaatcctgcctccgcccttcagtgttgggattacagatatgaaccaccatgcccggccccatttcacccctttgaaccagtttctaattttaagatggggttaccagggttccaagtataataagggacagtgcctgttccccacaaatgctgagttcccgccctttgctcacagaattctttccgtctgaaattcctcttactactaaattcggcatcgtttaaggcccagcccaaggatgctgattaagatctctgccttaggagggtgcggtgagctgagattgcctcctccatctc

SEQ ID NO: 334669 - DNA, 192 bp, Homo sapiens
ccccaaagttccaatattttttcacacaacccagcaccttgtgctgagcgccccacttggaaaccactgatttgctttatcaaaaaaaaagtggttttgtacatgatattaaagtgtaaaacaatgccttatgcccaatgttagtagcaactgaatagtttatataaaagtatctggtaagtagggcttggt

SEQ ID NO: 334670 - DNA, 239 bp, Homo sapiens
cgaggagagtgattttatatcccgtgttctggctttctttgcagcaagtgatggcatagtaaatgaaaacttggtggagcgatttagccaagaagttcagattacagaagcccgctgtttctatgacttccaaattgccatggaaaacacacattctgaaatgtatagtctccttattgacacttacataaaagatgccaaagaaagggaatttctcttcaacaccattgaaacacctt

SEQ ID NO: 334671 - DNA, 234 bp, Homo sapiens
atggaaaggctgggaaaacttcaagggacaagtgacattgaattggaccttggagaatatgcagaatttattgtagatacgtagagtccagagaaaaggggactccagatgagggaggtttgtggccagaagtacagcatgagacatgaatgagaataaacaaagattacaggaatgtcttggctctgtgtgacctccatcatgggacatgaagccacacgaagctaggtgaga

SEQ ID NO: 334672 - DNA, 93 bp, Homo sapiens
cttaatcaaatgaaagaatctaaactctagaacatctctggtttcaattcaaaatatatctgaatcaaaacttcagtttcttgtcaaattcct

SEQ ID NO: 334673 - DNA, 364 bp, Homo sapiens
ctagctctggatcaaggacagggagagggattaacgctgaaccaaccagaaaaaggtttgtctgacactggggacagggcaggaagcaccactatgatgggggagggggagattctggaaccatttttgcacagaatgctgtctgccagtctggcttctaaaaacagcatcagcgttgggccagagcaattaatgttctaataacagtcacaagtcgttctgttctaagaataacccccatggccgttgggccaggtactggtcctgtgttactcatttaaccctcagcatccttgggaggcggatgacatgatcattccattttacagaagagaaaaccaaagcacagagaaggaagggcttt

SEQ ID NO: 334674 - DNA, 360 bp, Homo sapiens
attaatgtaaagcgaagccgctcctatctctaccccttgggtcctggacctatatattcctcccagtgggacatagcgccttattggttggtgattagagtgtacactgtgccctggaaggtagtaacccctccttacttggtatcatcgactctgagctggcatctcagctacgccttcaacagcccatttcttctcttcgttcaagccagtatcttctgggtggtgcagaatgtgacaggaccagtgatcccatggtcacgtgccattgtcatgcctccttcgccttgcaatgaacgggcccttgggtctgatgtgatgttacgtgggaacctatgtcagtgggtaaaacactcagta

SEQ ID NO: 334675 - DNA, 2052 bp, Homo sapiens
ctcatttttttttttaaaaatcacattatctgtatttccagacataaggtaagtatttcaccaactttcatccaaactaacatcctcaattgtaatcccactaagaaccgccagggcgagacgaaagcggaatcgcttccatctttacgtggagtccgggaaatggttcagcaccatgacatccgccgaagacgtaggtgtagacgaggaacaaaagagaagacccctcgtggaggtggcctgtggggcccgccctcaccgggcgccatctgtccctgattctgctccccgcaggggccgcagcgggtgcgcccggcgatagagcgggctgtggagggagcctccatggagtctccatcaaccattccggaccaggagacggtggcaggcagtaaaaaggcctaggcagggccagcgccccgggctgctagcacaggacggcggcgcccagggacgccccagggcaggcctcagcccctccaacccgcgagagcccagctccaagggagcctgcagctccctccatcttggttgatggaggcggggatctgcgtctgggtgtctccaccgtcgcgcccgaccagtactgccccgcggacgcagacgccggcagctggggctgttcccttgtccgaatggcagagcccagtcggggcttccgggacaagtcctggccccacggggtttggttttgaggggtcccaagttcccacagttgtcccgacaaaatggaggacgtcgtctcctcctgctgcagccatggcgggaggtgggggactattccccacggggcgcggcgagggtggaagggcctccactgaccgcagcgcactcaagactccagttcaaccgcggccccgaaagctcacttggccccgctccagcacctccccggcctcgcccctcttgggggccttcaaggaactggacagggagggcgctggggcatccaggccgccgctctcctcgagcagaggcgttgggagccgctgccgcagcttgggcccccgggctcgggcgagggcaggcggccccgccggagtctcccgggctgtgtaggtcccggagagccccgggccccgaggggccgaagcgggccgctacgacgggcggcgaatctcgggctcctgacctggcggacccggtagctgggggcgggagaccggcggggagacaacccgaccgggagttgagggctggcaggcgggagtggaactgcagggccgcgggtgtggcccgcacctgacggacagctcttcggccaccccaccgagggggcgccctgaaggacggccgtcggagccaatgggcgtgcccaaggcgcccaggctcgtctccctcgccagccaacgagcgcacggagggtggggcctcctcgggctctgctgcgccgtcccctgcttctccgcctcctcaccagcgcgaaaagccgggactggacctagcggagttgtgcttgtcgccgaagcggggtgggcttgttcgttccgcgcagccgcagccagaaccgggtgacgcttatccccgctgtctttccagtccagggccgctgagagtgggggtggctgggagcagcgcagcctccggaggaggaggcggaggccgaggtgagtggggaggcggagatgggtgagagcagcctccggaggctcccaccgacccgggattaataccccgcggcgcggccgccgtcgccgttgccgcttcggggcctcgagggcagctcggggctgccctcctgtcaccggcgcttttgcgtccggcctgaggggctgggagagtgcgagcgaggccgggagggttgggtgaggcggtcgccagcggcggaggtcgcggggccggcggggaggcggggtggcggggcgggttgccggccgcccggggaggtcgcggggcatttttctttctctcctgccgcatagtggcggggggcgggttgggcgagggaggggcgccccggccgggtcttcgctgtcaggaccgcgctgccaccctgccgccggagccgaggtccccaggtttttcgggcgagggcttctgcctctgccccgc

SEQ ID NO: 334676 - DNA, 3165 bp, Homo sapiens
ctcatttttttttttaaaaatcacattatctgtatttccagacataaggtaagtatttcaccaactttcatccaaactaacatcctcaattgtaatcccactaagaaccgccagggcgagacgaaagcggaatcgcttccatctttacgtggagtccgggaaatggttcagcaccatgacatccgccgaagacgtaggtgtagacgaggaacaaaagagaagacccctcgtggaggtggcctgtggggcccgccctcaccgggcgccatctgtccctgattctgctccccgcaggggccgcagcgggtgcgcccggcgatagagcgggctgtggagggagcctccatggagtctccatcaaccattccggaccaggagacggtggcaggcagtaaaaaggcctaggcagggccagcgccccgggctgctagcacaggacggcggcgcccagggacgccccagggcaggcctcagcccctccaacccgcgagagcccagctccaagggagcctgcagctccctccatcttggttgatggaggcggggatctgcgtctgggtgtctccaccgtcgcgcccgaccagtactgccccgcggacgcagacgccggcagctggggctgttcccttgtccgaatggcagagcccagtcggggcttccgggacaagtcctggccccacggggtttggttttgaggggtcccaagttcccacagttgtcccgacaaaatggaggacgtcgtctcctcctgctgcagccatggcgggaggtgggggactattccccacggggcgcggcgagggtggaagggcctccactgaccgcagcgcactcaagactccagttcaaccgcggccccgaaagctcacttggccccgctccagcacctccccggcctcgcccctcttgggggccttcaaggaactggacagggagggcgctggggcatccaggccgccgctctcctcgagcagaggcgttgggagccgctgccgcagcttgggcccccgggctcgggcgagggcaggcggccccgccggagtctcccgggctgtgtaggtcccggagagccccgggccccgaggggccgaagcgggccgctacgacgggcggcgaatctcgggctcctgacctggcggacccggtagctgggggcgggagaccggcggggagacaacccgaccgggagttgagggctggcaggcgggagtggaactgcagggccgcgggtgtggcccgcacctgacggacagctcttcggccaccccaccgagggggcgccctgaaggacggccgtcggagccaatgggcgtgcccaaggcgcccaggctcgtctccctcgccagccaacgagcgcacggagggtggggcctcctcgggctctgctgcgccgtcccctgcttctccgcctcctcaccagcgcgaaaagccgggactggacctagcggagttgtgcttgtcgccgaagcggggtgggcttgttcgttccgcgcagccgcagccagaaccgggtgacgcttatccccgctgtctttccagtccagggccgctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaaggtaaatgcaggaatgggtaatagtggtatcactacagaattgactctgaaatacattattactaatgttacaaccttagaaacaggtataagctctgtgaatgctgggcaagatgtgaacataattattacatataaaacatcactatagaataccaacttgggagatgtcgctaaaggacttcagtcaagtaattttggtgttaatatacaaacgtacaccccatctttaactccacagaccaagactggagtaagaccttttaaccctggtagaatgaatgtggcaggagacttatttcagaatggagaatttgcaactcatcatagtcctgattcttggatctcccagtcagcttcatttcccagtaatcagaaacagccaggggtggattctttatcaccagtggccttacttcgtaagcagaatttccagcctacagcccaacaacaacttactaaaccagctaaaatcacttgtgcaaattgcaaaaagcctttacagaagggacagacagcttatcaacgaaaaggatcagctcacctcttttgctctaccacctgcctttcttccttctctcataaacgtactcaaaacacacgaagcataatatgtaaaaaagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagaggtctggatttttatacctaagttgttgtttaggctaacagtgataattttaacttttaagtgctattatgtactctttcatctacataatgcacgtgttctggatgtataacatgaagctgaaaggaagaataaggatatgttagaactatcttatgggatattttataaataaaattccatttgcatagcatggaaagtac

SEQ ID NO: 334677 - DNA, 4945 bp, Homo sapiens
ctcatttttttttttaaaaatcacattatctgtatttccagacataaggtaagtatttcaccaactttcatccaaactaacatcctcaattgtaatcccactaagaaccgccagggcgagacgaaagcggaatcgcttccatctttacgtggagtccgggaaatggttcagcaccatgacatccgccgaagacgtaggtgtagacgaggaacaaaagagaagacccctcgtggaggtggcctgtggggcccgccctcaccgggcgccatctgtccctgattctgctccccgcaggggccgcagcgggtgcgcccggcgatagagcgggctgtggagggagcctccatggagtctccatcaaccattccggaccaggagacggtggcaggcagtaaaaaggcctaggcagggccagcgccccgggctgctagcacaggacggcggcgcccagggacgccccagggcaggcctcagcccctccaacccgcgagagcccagctccaagggagcctgcagctccctccatcttggttgatggaggcggggatctgcgtctgggtgtctccaccgtcgcgcccgaccagtactgccccgcggacgcagacgccggcagctggggctgttcccttgtccgaatggcagagcccagtcggggcttccgggacaagtcctggccccacggggtttggttttgaggggtcccaagttcccacagttgtcccgacaaaatggaggacgtcgtctcctcctgctgcagccatggcgggaggtgggggactattccccacggggcgcggcgagggtggaagggcctccactgaccgcagcgcactcaagactccagttcaaccgcggccccgaaagctcacttggccccgctccagcacctccccggcctcgcccctcttgggggccttcaaggaactggacagggagggcgctggggcatccaggccgccgctctcctcgagcagaggcgttgggagccgctgccgcagcttgggcccccgggctcgggcgagggcaggcggccccgccggagtctcccgggctgtgtaggtcccggagagccccgggccccgaggggccgaagcgggccgctacgacgggcggcgaatctcgggctcctgacctggcggacccggtagctgggggcgggagaccggcggggagacaacccgaccgggagttgagggctggcaggcgggagtggaactgcagggccgcgggtgtggcccgcacctgacggacagctcttcggccaccccaccgagggggcgccctgaaggacggccgtcggagccaatgggcgtgcccaaggcgcccaggctcgtctccctcgccagccaacgagcgcacggagggtggggcctcctcgggctctgctgcgccgtcccctgcttctccgcctcctcaccagcgcgaaaagccgggactggacctagcggagttgtgcttgtcgccgaagcggggtgggcttgttcgttccgcgcagccgcagccagaaccgggtgacgcttatccccgctgtctttccagtccagggccgctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaagaccaagactggagtaagaccttttaaccctggtagaatgaatgtggcaggagacttatttcagaatggagaatttgcaactcatcatagtcctgattcttggatctcccagtcagcttcatttcccagtaatcagaaacagccaggggtggattctttatcaccagtggccttacttcgtaagcagaatttccagcctacagcccaacaacaacttactaaaccagctaaaatcacttgtgcaaattgcaaaaagcctttacagaagggacagacagcttatcaacgaaaaggatcagctcacctcttttgctctaccacctgcctttcttccttctctcataaacgtactcaaaacacacgaagcataatatgtaaaaaagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagagattcgccatgaagtcagcgtaaataatgtaacacataaactgtgcagtaaccattgctttaataagtacagattggccaatggtctaataatgaactgctgtgaacactgtggagagtacatgcctagtaagagtactggaaacaacatcctggtgattggaggtcagcagaagagattttgctgccaaagttgtattaacgaatataaacagatgatggaaacaaaatcaaaaaaattaacagcatcagaaaatagaaaaaggaatgcttttagagaagaaaatgagaaacaattatatggatcgtcaaatacacttttgaaaaaaatagagggaatcccagaaaaaaaggaaaagacttcacagctacagctttcagtagaatgtggcacggatacattactgatccaagagaatgtgaatttacctccttcttccacgtcaaccatagctgatacatttcaagagcaactggaagagaaaaattttgaagactccattgtaccagttgtgctttccgcagatccaggtacgtggccccgaattttgaatattaaacaacgggacactcttgttgaaaatgttccgcctcaagtaagaaattttaactttccaaaagataatacagggaggaagttttcagaaacttattatacacggattcttccaaatggtgaaaaaaccactagatcctggttactttattcaacctcaaaagattctgtgttttgtctatattgcaaactctttggggaaggaaaaaatcaactgaaaaatgaaaatgggtgcaaagattggcaacatttatcacatattcttagtaaacatgaagaaagtgaaatgcacatcaacaatagtgttaagtactcaaaattaaaatctgatctgaaaaaaaataaagctattgatgctgcagaacgcagattatatgaaaatgagaaaaatgatggtgtgctgttgttgtacacgtaatatacctgagttgttttttggcatgatgatcagaatcttacattactcagaaaacatctgtcctgcaatagtcagtactattgtgttgtaagtctcctctacagagtaacttgcagcagttccttagcaataagtatgatagcaaataaatagcaaagaatgtttccattctaaatctaaaactaattagattcaatcatcattaggcaatgacttcattaggcaatgaagattaacaataggtaattgttaatcttcaaaatctatcaatttacacctatttaaaaattggcatttaatgactgccatttgatgggtttggttaatattctgttcttggccgggcgcaatggctcacgcctgtaatccaagaactttgggaggctcaggcgggtagatcaattgaggtcagaagttcaagaccagcctggccaacaaggtgaaaccccgtctcaactaaaaatacaaaaacattagccaggtgtggtggcacacacctgtagtcccagctactcaggaggctgaggcaggagaatcgcttgaacccaggaggcagaggttgcagtgagctgagattgcaccactgcagtccagcctgagcaacagagcgagagtcagtctcaaaagaaagaaaaatattatgttctaattaccttgaaagaggaaagaaaggcttgaattgatcaataccagtttgaataagatacttatgtgaacaagcattctcaacattattattaaagtaaaactactcagtttacagaatgggatctgaaactacagctttttgctattaaaccaaatacttgtgatctactttgtttgagcaaaacagcattatttgttatgttaatgatggttaatttccattttattggttttatgtttattttaatttgtaaatgttttagcatttattattgtatgtgaactatatttacctattttatgttgataaaaatataaaaaatattaaaataagtatatattaagttaaccttcaagtgttatgggcttttttctccctgtgaaaagagatggcatgcttgaaatttgagatacaccaatgaaaattaaggatttaagttattttagatggtcagcagccccatcactgtgtatttagtaaatctcccttctgtttctgatttctgatgtcaattttgtaatatattaaatttttatatactattcctgtgaaacaaaatggcatatgagcagtgactaggacagaaggtgcgttcttgtgg

SEQ ID NO: 334678 - DNA, 3211 bp, Homo sapiens
ctcatttttttttttaaaaatcacattatctgtatttccagacataaggtaagtatttcaccaactttcatccaaactaacatcctcaattgtaatcccactaagaaccgccagggcgagacgaaagcggaatcgcttccatctttacgtggagtccgggaaatggttcagcaccatgacatccgccgaagacgtaggtgtagacgaggaacaaaagagaagacccctcgtggaggtggcctgtggggcccgccctcaccgggcgccatctgtccctgattctgctccccgcaggggccgcagcgggtgcgcccggcgatagagcgggctgtggagggagcctccatggagtctccatcaaccattccggaccaggagacggtggcaggcagtaaaaaggcctaggcagggccagcgccccgggctgctagcacaggacggcggcgcccagggacgccccagggcaggcctcagcccctccaacccgcgagagcccagctccaagggagcctgcagctccctccatcttggttgatggaggcggggatctgcgtctgggtgtctccaccgtcgcgcccgaccagtactgccccgcggacgcagacgccggcagctggggctgttcccttgtccgaatggcagagcccagtcggggcttccgggacaagtcctggccccacggggtttggttttgaggggtcccaagttcccacagttgtcccgacaaaatggaggacgtcgtctcctcctgctgcagccatggcgggaggtgggggactattccccacggggcgcggcgagggtggaagggcctccactgaccgcagcgcactcaagactccagttcaaccgcggccccgaaagctcacttggccccgctccagcacctccccggcctcgcccctcttgggggccttcaaggaactggacagggagggcgctggggcatccaggccgccgctctcctcgagcagaggcgttgggagccgctgccgcagcttgggcccccgggctcgggcgagggcaggcggccccgccggagtctcccgggctgtgtaggtcccggagagccccgggccccgaggggccgaagcgggccgctacgacgggcggcgaatctcgggctcctgacctggcggacccggtagctgggggcgggagaccggcggggagacaacccgaccgggagttgagggctggcaggcgggagtggaactgcagggccgcgggtgtggcccgcacctgacggacagctcttcggccaccccaccgagggggcgccctgaaggacggccgtcggagccaatgggcgtgcccaaggcgcccaggctcgtctccctcgccagccaacgagcgcacggagggtggggcctcctcgggctctgctgcgccgtcccctgcttctccgcctcctcaccagcgcgaaaagccgggactggacctagcggagttgtgcttgtcgccgaagcggggtgggcttgttcgttccgcgcagccgcagccagaaccgggtgacgcttatccccgctgtctttccagtccagggccgctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaaggtaaatgcaggaatgggtaatagtggtatcactacagaattgactctgaaatacattattactaatgttacaaccttagaaacaggtataagctctgtgaatgctgggcaagatgtgaacataattattacatataaaacatcactatagaataccaacttgggagatgtcgctaaaggacttcagtcaagtaattttggtgttaatatacaaacgtacaccccatctttaactccacagaccaagactggagtaagaccttttaaccctggtagaatgaatgtggcaggagacttatttcagaatggagaatttgcaactcatcatagtcctgattcttggatctcccagtcagcttcatttcccagtaatcagaaacagccaggggtggattctttatcaccagtggccttacttcgtaagcagaatttccagcctacagcccaacaacaacttactaaaccagctaaaatcacttgtgcaaattgcaaaaagcctttacagaagggacagacagcttatcaacgaaaaggatcagctcacctcttttgctctaccacctgcctttcttccttctctcataaacgtactcaaaacacacgaagcataatatgtaaaaaagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagagattcgccatgaagtcagcgtaaataatgtaacacataaactgtgcagtaaccattgctttaataagtacagattggccaatggtctaataatgaactgctgtgaacactgtggagagtacatgcctagtaagagtactggaaacaacatcctggtgattggaggtcagcagaagagattttgctgccaaagttgtattaacgaatataaacagatgatggaaacaaaatcaaaaaaattaacagcatc

SEQ ID NO: 334679 - DNA, 4851 bp, Homo sapiens
ctcatttttttttttaaaaatcacattatctgtatttccagacataaggtaagtatttcaccaactttcatccaaactaacatcctcaattgtaatcccactaagaaccgccagggcgagacgaaagcggaatcgcttccatctttacgtggagtccgggaaatggttcagcaccatgacatccgccgaagacgtaggtgtagacgaggaacaaaagagaagacccctcgtggaggtggcctgtggggcccgccctcaccgggcgccatctgtccctgattctgctccccgcaggggccgcagcgggtgcgcccggcgatagagcgggctgtggagggagcctccatggagtctccatcaaccattccggaccaggagacggtggcaggcagtaaaaaggcctaggcagggccagcgccccgggctgctagcacaggacggcggcgcccagggacgccccagggcaggcctcagcccctccaacccgcgagagcccagctccaagggagcctgcagctccctccatcttggttgatggaggcggggatctgcgtctgggtgtctccaccgtcgcgcccgaccagtactgccccgcggacgcagacgccggcagctggggctgttcccttgtccgaatggcagagcccagtcggggcttccgggacaagtcctggccccacggggtttggttttgaggggtcccaagttcccacagttgtcccgacaaaatggaggacgtcgtctcctcctgctgcagccatggcgggaggtgggggactattccccacggggcgcggcgagggtggaagggcctccactgaccgcagcgcactcaagactccagttcaaccgcggccccgaaagctcacttggccccgctccagcacctccccggcctcgcccctcttgggggccttcaaggaactggacagggagggcgctggggcatccaggccgccgctctcctcgagcagaggcgttgggagccgctgccgcagcttgggcccccgggctcgggcgagggcaggcggccccgccggagtctcccgggctgtgtaggtcccggagagccccgggccccgaggggccgaagcgggccgctacgacgggcggcgaatctcgggctcctgacctggcggacccggtagctgggggcgggagaccggcggggagacaacccgaccgggagttgagggctggcaggcgggagtggaactgcagggccgcgggtgtggcccgcacctgacggacagctcttcggccaccccaccgagggggcgccctgaaggacggccgtcggagccaatgggcgtgcccaaggcgcccaggctcgtctccctcgccagccaacgagcgcacggagggtggggcctcctcgggctctgctgcgccgtcccctgcttctccgcctcctcaccagcgcgaaaagccgggactggacctagcggagttgtgcttgtcgccgaagcggggtgggcttgttcgttccgcgcagccgcagccagaaccgggtgacgcttatccccgctgtctttccagtccagggccgctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaagattcttggatctcccagtcagcttcatttcccagtaatcagaaacagccaggggtggattctttatcaccagtggccttacttcgtaagcagaatttccagcctacagcccaacaacaacttactaaaccagctaaaatcacttgtgcaaattgcaaaaagcctttacagaagggacagacagcttatcaacgaaaaggatcagctcacctcttttgctctaccacctgcctttcttccttctctcataaacgtactcaaaacacacgaagcataatatgtaaaaaagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagagattcgccatgaagtcagcgtaaataatgtaacacataaactgtgcagtaaccattgctttaataagtacagattggccaatggtctaataatgaactgctgtgaacactgtggagagtacatgcctagtaagagtactggaaacaacatcctggtgattggaggtcagcagaagagattttgctgccaaagttgtattaacgaatataaacagatgatggaaacaaaatcaaaaaaattaacagcatcagaaaatagaaaaaggaatgcttttagagaagaaaatgagaaacaattatatggatcgtcaaatacacttttgaaaaaaatagagggaatcccagaaaaaaaggaaaagacttcacagctacagctttcagtagaatgtggcacggatacattactgatccaagagaatgtgaatttacctccttcttccacgtcaaccatagctgatacatttcaagagcaactggaagagaaaaattttgaagactccattgtaccagttgtgctttccgcagatccaggtacgtggccccgaattttgaatattaaacaacgggacactcttgttgaaaatgttccgcctcaagtaagaaattttaactttccaaaagataatacagggaggaagttttcagaaacttattatacacggattcttccaaatggtgaaaaaaccactagatcctggttactttattcaacctcaaaagattctgtgttttgtctatattgcaaactctttggggaaggaaaaaatcaactgaaaaatgaaaatgggtgcaaagattggcaacatttatcacatattcttagtaaacatgaagaaagtgaaatgcacatcaacaatagtgttaagtactcaaaattaaaatctgatctgaaaaaaaataaagctattgatgctgcagaacgcagattatatgaaaatgagaaaaatgatggtgtgctgttgttgtacacgtaatatacctgagttgttttttggcatgatgatcagaatcttacattactcagaaaacatctgtcctgcaatagtcagtactattgtgttgtaagtctcctctacagagtaacttgcagcagttccttagcaataagtatgatagcaaataaatagcaaagaatgtttccattctaaatctaaaactaattagattcaatcatcattaggcaatgacttcattaggcaatgaagattaacaataggtaattgttaatcttcaaaatctatcaatttacacctatttaaaaattggcatttaatgactgccatttgatgggtttggttaatattctgttcttggccgggcgcaatggctcacgcctgtaatccaagaactttgggaggctcaggcgggtagatcaattgaggtcagaagttcaagaccagcctggccaacaaggtgaaaccccgtctcaactaaaaatacaaaaacattagccaggtgtggtggcacacacctgtagtcccagctactcaggaggctgaggcaggagaatcgcttgaacccaggaggcagaggttgcagtgagctgagattgcaccactgcagtccagcctgagcaacagagcgagagtcagtctcaaaagaaagaaaaatattatgttctaattaccttgaaagaggaaagaaaggcttgaattgatcaataccagtttgaataagatacttatgtgaacaagcattctcaacattattattaaagtaaaactactcagtttacagaatgggatctgaaactacagctttttgctattaaaccaaatacttgtgatctactttgtttgagcaaaacagcattatttgttatgttaatgatggttaatttccattttattggttttatgtttattttaatttgtaaatgttttagcatttattattgtatgtgaactatatttacctattttatgttgataaaaatataaaaaatattaaaataagtatatattaagttaaccttcaagtgttatgggcttttttctccctgtgaaaagagatggcatgcttgaaatttgagatacaccaatgaaaattaaggatttaagttattttagatggtcagcagccccatcactgtgtatttagtaaatctcccttctgtttctgatttctgatgtcaattttgtaatatattaaatttttatatactattcctgtgaaacaaaatggcatatgagcagtgactaggacagaaggtgcgttcttgtgg

SEQ ID NO: 334680 - DNA, 3223 bp, Homo sapiens
aaaatttaaggttaatactagaaacggacctcttttatctatgctatgtcaaggtaaagagttaaaatagccaccactacccaaagactaaccctttgacagatgaccttaaccttttttttttaaataaaaaaaaaaaaagtagctaatattttttgagtgtgcctgtgtgccaggcattacttttatgtcatgtgttcttcatagcactctgatgagttaggtatcatcaattagtatatttgtataatattacattcaggagatctttgaacctggagtctgacttaagagccgatggctaccacattacacaattccagacgccaacatttactttattattattgttggcacagtggagtatcattcacttgagatacaaagtggatagtccccctgggattgtgcatcaagagtgtttggccttaaccacatgtttatacgcctgccccacttgtctcttaaactcttaaatgaaaatgcaagttatttttctgatgtacattttgatttgttccatgatttttttcttgtttcatttttaagattcttggatctcccagtcagcttcatttcccagtaatcagaaacagccaggggtggattctttatcaccagtggccttacttcgtaagcagaatttccagcctacagcccaacaacaacttactaaaccagctaaaatcacttgtgcaaattgcaaaaagcctttacagaagggacagacagcttatcaacgaaaaggatcagctcacctcttttgctctaccacctgcctttcttccttctctcataaacgtactcaaaacacacgaagcataatatgtaaaaaagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagagattcgccatgaagtcagcgtaaataatgtaacacataaactgtgcagtaaccattgctttaataagtacagattggccaatggtctaataatgaactgctgtgaacactgtggagagtacatgcctagtaagagtactggaaacaacatcctggtgattggaggtcagcagaagagattttgctgccaaagttgtattaacgaatataaacagatgatggaaacaaaatcaaaaaaattaacagcatcagaaaatagaaaaaggaatgcttttagagaagaaaatgagaaacaattatatggatcgtcaaatacacttttgaaaaaaatagagggaatcccagaaaaaaaggaaaagacttcacagctacagctttcagtagaatgtggcacggatacattactgatccaagagaatgtgaatttacctccttcttccacgtcaaccatagctgatacatttcaagagcaactggaagagaaaaattttgaagactccattgtaccagttgtgctttccgcagatccaggtacgtggccccgaattttgaatattaaacaacgggacactcttgttgaaaatgttccgcctcaagtaagaaattttaactttccaaaagataatacagggaggaagttttcagaaacttattatacacggattcttccaaatggtgaaaaaaccactagatcctggttactttattcaacctcaaaagattctgtgttttgtctatattgcaaactctttggggaaggaaaaaatcaactgaaaaatgaaaatgggtgcaaagattggcaacatttatcacatattcttagtaaacatgaagaaagtgaaatgcacatcaacaatagtgttaagtactcaaaattaaaatctgatctgaaaaaaaataaagctattgatgctgcagaacgcagattatatgaaaatgagaaaaatgatggtgtgctgttgttgtacacgtaatatacctgagttgttttttggcatgatgatcagaatcttacattactcagaaaacatctgtcctgcaatagtcagtactattgtgttgtaagtctcctctacagagtaacttgcagcagttccttagcaataagtatgatagcaaataaatagcaaagaatgtttccattctaaatctaaaactaattagattcaatcatcattaggcaatgacttcattaggcaatgaagattaacaataggtaattgttaatcttcaaaatctatcaatttacacctatttaaaaattggcatttaatgactgccatttgatgggtttggttaatattctgttcttggccgggcgcaatggctcacgcctgtaatccaagaactttgggaggctcaggcgggtagatcaattgaggtcagaagttcaagaccagcctggccaacaaggtgaaaccccgtctcaactaaaaatacaaaaacattagccaggtgtggtggcacacacctgtagtcccagctactcaggaggctgaggcaggagaatcgcttgaacccaggaggcagaggttgcagtgagctgagattgcaccactgcagtccagcctgagcaacagagcgagagtcagtctcaaaagaaagaaaaatattatgttctaattaccttgaaagaggaaagaaaggcttgaattgatcaataccagtttgaataagatacttatgtgaacaagcattctcaacattattattaaagtaaaactactcagtttacagaatgggatctgaaactacagctttttgctattaaaccaaatacttgtgatctactttgtttgagcaaaacagcattatttgttatgttaatgatggttaatttccattttattggttttatgtttattttaatttgtaaatgttttagcatttattattgtatgtgaactatatttacctattttatgttgataaaaatataaaaaatattaaaataagtatatattaagttaaccttcaagtgttatgggcttttttctccctgtgaaaagagatggcatgcttgaaatttgagatacaccaatgaaaattaaggatttaagttattttagatggtcagcagccccatcactgtgtatttagtaaatctcccttctgtttctgatttctgatgtcaattttgtaatatattaaatttttatatactattcctgtgaaacaaaatggcatatgagcagtgactaggacagaaggtgcgttcttgtgg

SEQ ID NO: 334681 - DNA, 2337 bp, Homo sapiens
  misc_feature (17)..(17): n is a, c, g, or t
tctatgcctttaaaaanagcctggtgcagtggtgcacacctgtagtcccagctacttagaaggctaatttttgtatttttagtagagacagggtttcaccatattggccagacttgttctcgaactcctgacctcaaatgatccatccaccttggcctcccaaagtgctgggattacaggcatgaaccaccgcacccgaccgtcgtcgtctttttgattggcatttctttgatgcctaatgatgagcatgtgcttattgagcatttgaatatacattaatttttaaaagtttaacctaaaataaaattataatcctctttgtcctcagatgatggaaacaaaatcaaaaaaattaacagcatcagaaaatagaaaaaggaatgcttttagagaagaaaatgagaaacaattatatggatcgtcaaatacacttttgaaaaaaatagagggaatcccagaaaaaaaggaaaagacttcacagctacagctttcagtagaatgtggcacggatacattactgatccaagagaatgtgaatttacctccttcttccacgtcaaccatagctgatacatttcaagagcaactggaagagaaaaattttgaagactccattgtaccagttgtgctttccgcagatccaggtacgtggccccgaattttgaatattaaacaacgggacactcttgttgaaaatgttccgcctcaagtaagaaattttaactttccaaaagataatacagggaggaagttttcagaaacttattatacacggattcttccaaatggtgaaaaaaccactagatcctggttactttattcaacctcaaaagattctgtgttttgtctatattgcaaactctttggggaaggaaaaaatcaactgaaaaatgaaaatgggtgcaaagattggcaacatttatcacatattcttagtaaacatgaagaaagtgaaatgcacatcaacaatagtgttaagtactcaaaattaaaatctgatctgaaaaaaaataaagctattgatgctgcagaacgcagattatatgaaaatgagaaaaatgatggtgtgctgttgttgtacacgtaatatacctgagttgttttttggcatgatgatcagaatcttacattactcagaaaacatctgtcctgcaatagtcagtactattgtgttgtaagtctcctctacagagtaacttgcagcagttccttagcaataagtatgatagcaaataaatagcaaagaatgtttccattctaaatctaaaactaattagattcaatcatcattaggcaatgacttcattaggcaatgaagattaacaataggtaattgttaatcttcaaaatctatcaatttacacctatttaaaaattggcatttaatgactgccatttgatgggtttggttaatattctgttcttggccgggcgcaatggctcacgcctgtaatccaagaactttgggaggctcaggcgggtagatcaattgaggtcagaagttcaagaccagcctggccaacaaggtgaaaccccgtctcaactaaaaatacaaaaacattagccaggtgtggtggcacacacctgtagtcccagctactcaggaggctgaggcaggagaatcgcttgaacccaggaggcagaggttgcagtgagctgagattgcaccactgcagtccagcctgagcaacagagcgagagtcagtctcaaaagaaagaaaaatattatgttctaattaccttgaaagaggaaagaaaggcttgaattgatcaataccagtttgaataagatacttatgtgaacaagcattctcaacattattattaaagtaaaactactcagtttacagaatgggatctgaaactacagctttttgctattaaaccaaatacttgtgatctactttgtttgagcaaaacagcattatttgttatgttaatgatggttaatttccattttattggttttatgtttattttaatttgtaaatgttttagcatttattattgtatgtgaactatatttacctattttatgttgataaaaatataaaaaatattaaaataagtatatattaagttaaccttcaagtgttatgggcttttttctccctgtgaaaagagatggcatgcttgaaatttgagatacaccaatgaaaattaaggatttaagttattttagatggtcagcagccccatcactgtgtatttagtaaatctcccttctgtttctgatttctgatgtcaattttgtaatatattaaatttttatatactattcctgtgaaacaaaatggcatatgagcagtgactaggacagaaggtgcgttcttgtgg

SEQ ID NO: 334682 - DNA, 926 bp, Homo sapiens
  misc_feature (20)..(20): n is a, c, g, or t
cggtatacatgattctccanacatcaagaccaacctacagttacttcaagtgggcaggagcctttatggaacttatcagggtcgaaatctttgaaacgccagcctggccaacaaggtgaaaccccgtctcaactaaaaatacaaaaacattagccaggtgtggtggcacacacctgtagtcccagctactcaggaggctgaggcaggagaatcgcttgaacccaggaggcagaggttgcagtgagctgagattgcaccactgcagtccagcctgagcaacagagcgagagtcagtctcaaaagaaagaaaaatattatgttctaattaccttgaaagaggaaagaaaggcttgaattgatcaataccagtttgaataagatacttatgtgaacaagcattctcaacattattattaaagtaaaactactcagtttacagaatgggatctgaaactacagctttttgctattaaaccaaatacttgtgatctactttgtttgagcaaaacagcattatttgttatgttaatgatggttaatttccattttattggttttatgtttattttaatttgtaaatgttttagcatttattattgtatgtgaactatatttacctattttatgttgataaaaatataaaaaatattaaaataagtatatattaagttaaccttcaagtgttatgggcttttttctccctgtgaaaagagatggcatgcttgaaatttgagatacaccaatgaaaattaaggatttaagttattttagatggtcagcagccccatcactgtgtatttagtaaatctcccttctgtttctgatttctgatgtcaattttgtaatatattaaatttttatatactattcctgtgaaacaaaatggcatatgagcagtgactaggacagaaggtgcgttcttgtgg

SEQ ID NO: 334683 - DNA, 370 bp, Homo sapiens
cagacagcttatcaacgaaaaggatcagctcacctcttttgctctaccacctgcctttcttccttctctcataaacgtactcaaaacacacgaagcataatatgtaaaaagtaagcagtacctttcaacatttctccacatagttgaatactaatggtataaataagtactcaatataactgcagagctggatagatttatgggtagaattgttgcaggagtgtcttcaagtttattgagcttgagctcctagaatatatccaagctgtggactcgtatgtgctgtatttactctcggcagaaaaatggaacataggtttggaaatcaattgcccctctccctgctactacatttgcctcccctgctccc

SEQ ID NO: 334684 - DNA, 2639 bp, Homo sapiens
ctcatttttttttttaaaaatcacattatctgtatttccagacataaggtaagtatttcaccaactttcatccaaactaacatcctcaattgtaatcccactaagaaccgccagggcgagacgaaagcggaatcgcttccatctttacgtggagtccgggaaatggttcagcaccatgacatccgccgaagacgtaggtgtagacgaggaacaaaagagaagacccctcgtggaggtggcctgtggggcccgccctcaccgggcgccatctgtccctgattctgctccccgcaggggccgcagcgggtgcgcccggcgatagagcgggctgtggagggagcctccatggagtctccatcaaccattccggaccaggagacggtggcaggcagtaaaaaggcctaggcagggccagcgccccgggctgctagcacaggacggcggcgcccagggacgccccagggcaggcctcagcccctccaacccgcgagagcccagctccaagggagcctgcagctccctccatcttggttgatggaggcggggatctgcgtctgggtgtctccaccgtcgcgcccgaccagtactgccccgcggacgcagacgccggcagctggggctgttcccttgtccgaatggcagagcccagtcggggcttccgggacaagtcctggccccacggggtttggttttgaggggtcccaagttcccacagttgtcccgacaaaatggaggacgtcgtctcctcctgctgcagccatggcgggaggtgggggactattccccacggggcgcggcgagggtggaagggcctccactgaccgcagcgcactcaagactccagttcaaccgcggccccgaaagctcacttggccccgctccagcacctccccggcctcgcccctcttgggggccttcaaggaactggacagggagggcgctggggcatccaggccgccgctctcctcgagcagaggcgttgggagccgctgccgcagcttgggcccccgggctcgggcgagggcaggcggccccgccggagtctcccgggctgtgtaggtcccggagagccccgggccccgaggggccgaagcgggccgctacgacgggcggcgaatctcgggctcctgacctggcggacccggtagctgggggcgggagaccggcggggagacaacccgaccgggagttgagggctggcaggcgggagtggaactgcagggccgcgggtgtggcccgcacctgacggacagctcttcggccaccccaccgagggggcgccctgaaggacggccgtcggagccaatgggcgtgcccaaggcgcccaggctcgtctccctcgccagccaacgagcgcacggagggtggggcctcctcgggctctgctgcgccgtcccctgcttctccgcctcctcaccagcgcgaaaagccgggactggacctagcggagttgtgcttgtcgccgaagcggggtgggcttgttcgttccgcgcagccgcagccagaaccgggtgacgcttatccccgctgtctttccagtccagggccgctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaagaccaagactggagtaagaccttttaaccctggtagaatgaatgtggcaggagacttatttcagaatggagaatttgcaactcatcatagtcctgagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagaggtctggatttttatacctaagttgttgtttaggctaacagtgataattttaacttttaagtgctattatgtactctttcatctacataatgcacgtgttctggatgtataacatgaagctgaaaggaagaataaggatatgttagaactatcttatgggatattttataaataaaattccatttgcatagcatggaaagtac

SEQ ID NO: 334685 - DNA, 2925 bp, Homo sapiens
ctcatttttttttttaaaaatcacattatctgtatttccagacataaggtaagtatttcaccaactttcatccaaactaacatcctcaattgtaatcccactaagaaccgccagggcgagacgaaagcggaatcgcttccatctttacgtggagtccgggaaatggttcagcaccatgacatccgccgaagacgtaggtgtagacgaggaacaaaagagaagacccctcgtggaggtggcctgtggggcccgccctcaccgggcgccatctgtccctgattctgctccccgcaggggccgcagcgggtgcgcccggcgatagagcgggctgtggagggagcctccatggagtctccatcaaccattccggaccaggagacggtggcaggcagtaaaaaggcctaggcagggccagcgccccgggctgctagcacaggacggcggcgcccagggacgccccagggcaggcctcagcccctccaacccgcgagagcccagctccaagggagcctgcagctccctccatcttggttgatggaggcggggatctgcgtctgggtgtctccaccgtcgcgcccgaccagtactgccccgcggacgcagacgccggcagctggggctgttcccttgtccgaatggcagagcccagtcggggcttccgggacaagtcctggccccacggggtttggttttgaggggtcccaagttcccacagttgtcccgacaaaatggaggacgtcgtctcctcctgctgcagccatggcgggaggtgggggactattccccacggggcgcggcgagggtggaagggcctccactgaccgcagcgcactcaagactccagttcaaccgcggccccgaaagctcacttggccccgctccagcacctccccggcctcgcccctcttgggggccttcaaggaactggacagggagggcgctggggcatccaggccgccgctctcctcgagcagaggcgttgggagccgctgccgcagcttgggcccccgggctcgggcgagggcaggcggccccgccggagtctcccgggctgtgtaggtcccggagagccccgggccccgaggggccgaagcgggccgctacgacgggcggcgaatctcgggctcctgacctggcggacccggtagctgggggcgggagaccggcggggagacaacccgaccgggagttgagggctggcaggcgggagtggaactgcagggccgcgggtgtggcccgcacctgacggacagctcttcggccaccccaccgagggggcgccctgaaggacggccgtcggagccaatgggcgtgcccaaggcgcccaggctcgtctccctcgccagccaacgagcgcacggagggtggggcctcctcgggctctgctgcgccgtcccctgcttctccgcctcctcaccagcgcgaaaagccgggactggacctagcggagttgtgcttgtcgccgaagcggggtgggcttgttcgttccgcgcagccgcagccagaaccgggtgacgcttatccccgctgtctttccagtccagggccgctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaagaccaagactggagtaagaccttttaaccctggtagaatgaatgtggcaggagacttatttcagaatggagaatttgcaactcatcatagtcctgattcttggatctcccagtcagcttcatttcccagtaatcagaaacagccaggggtggattctttatcaccagtggccttacttcgtaagcagaatttccagcctacagcccaacaacaacttactaaaccagctaaaatcacttgtgcaaattgcaaaaagcctttacagaagggacagacagcttatcaacgaaaaggatcagctcacctcttttgctctaccacctgcctttcttccttctctcataaacgtactcaaaacacacgaagcataatatgtaaaaaagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagaggtctggatttttatacctaagttgttgtttaggctaacagtgataattttaacttttaagtgctattatgtactctttcatctacataatgcacgtgttctggatgtataacatgaagctgaaaggaagaataaggatatgttagaactatcttatgggatattttataaataaaattccatttgcatagcatggaaagtac

SEQ ID NO: 334686 - DNA, 4690 bp, Homo sapiens
ctcatttttttttttaaaaatcacattatctgtatttccagacataaggtaagtatttcaccaactttcatccaaactaacatcctcaattgtaatcccactaagaaccgccagggcgagacgaaagcggaatcgcttccatctttacgtggagtccgggaaatggttcagcaccatgacatccgccgaagacgtaggtgtagacgaggaacaaaagagaagacccctcgtggaggtggcctgtggggcccgccctcaccgggcgccatctgtccctgattctgctccccgcaggggccgcagcgggtgcgcccggcgatagagcgggctgtggagggagcctccatggagtctccatcaaccattccggaccaggagacggtggcaggcagtaaaaaggcctaggcagggccagcgccccgggctgctagcacaggacggcggcgcccagggacgccccagggcaggcctcagcccctccaacccgcgagagcccagctccaagggagcctgcagctccctccatcttggttgatggaggcggggatctgcgtctgggtgtctccaccgtcgcgcccgaccagtactgccccgcggacgcagacgccggcagctggggctgttcccttgtccgaatggcagagcccagtcggggcttccgggacaagtcctggccccacggggtttggttttgaggggtcccaagttcccacagttgtcccgacaaaatggaggacgtcgtctcctcctgctgcagccatggcgggaggtgggggactattccccacggggcgcggcgagggtggaagggcctccactgaccgcagcgcactcaagactccagttcaaccgcggccccgaaagctcacttggccccgctccagcacctccccggcctcgcccctcttgggggccttcaaggaactggacagggagggcgctggggcatccaggccgccgctctcctcgagcagaggcgttgggagccgctgccgcagcttgggcccccgggctcgggcgagggcaggcggccccgccggagtctcccgggctgtgtaggtcccggagagccccgggccccgaggggccgaagcgggccgctacgacgggcggcgaatctcgggctcctgacctggcggacccggtagctgggggcgggagaccggcggggagacaacccgaccgggagttgagggctggcaggcgggagtggaactgcagggccgcgggtgtggcccgcacctgacggacagctcttcggccaccccaccgagggggcgccctgaaggacggccgtcggagccaatgggcgtgcccaaggcgcccaggctcgtctccctcgccagccaacgagcgcacggagggtggggcctcctcgggctctgctgcgccgtcccctgcttctccgcctcctcaccagcgcgaaaagccgggactggacctagcggagttgtgcttgtcgccgaagcggggtgggcttgttcgttccgcgcagccgcagccagaaccgggtgacgcttatccccgctgtctttccagtccagggccgctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaagaccaagactggagtaagaccttttaaccctggtagaatgaatgtggcaggagacttatttcagaatggagaatttgcaactcatcatagtcctgattcttggatctcccagtcagcttcatttcccagtaatcagaaacagccaggggtggattctttatcaccagtggccttacttcgtaagcagaatttccagcctacagcccaacaacaacttactaaaccagctaaaatcacttgtgcaaattgcaaaaagcctttacagaagggacagacagcttatcaacgaaaaggatcagctcacctcttttgctctaccacctgcctttcttccttctctcataaacgtactcaaaacacacgaagcataatatgtaaaaaagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagagattcgccatgaagtcagcgtaaataatgtaacacataaactgtgcagtaaccattgctttaataagtacagattggccaatggtctaataatgaactgctgtgaacactgtggagagtacatgcctagtaagagtactggaaacaacatcctggtgattggaggtcagcagaagagattttgctgccaaagttgtattaacgaatataaacagatgatggaaacaaaatcaaaaaaattaacagcatcagaaaatagaaaaaggaatgcttttagagaagaaaatgagaaacaattatatggatcgtcaaatacacttttgaaaaaaatagagggaatcccagaaaaaaaggaaaagacttcacagctacagctttcagtagaatgtggcacggatacattactgatccaagagaatgtgaatttacctccttcttccacgtcaaccatagctgatacatttcaagagcaactggaagagaaaaattttgaagactccattgtaccagttgtgctttccgcagatccaggtacgtggccccgaattttgaatattaaacaacgggacactcttgttgaaaatgttccgcctcaagtaagaaattttaactttccaaaagataatacagggaggaagttttcagaaacttattatacacggattcttccaaatggtgaaaaaaccactagatcctggttactttattcaacctcaaaagattctgtgttttgtctatattgcaaactctttggggaaggaaaaaatcaactgaaaaatgaaaatgggtgcaaagattggcaacatttatcacatattcttagtaaacatgaagaaagtgaaatgcacatcaacaatagtgttaagtactcaaaattaaaatctgatctgaaaaaaaataaagctattgatgctgcagaacgcagattatatgaaaatgagaaaaatgatggtgtgctgttgttgtacacgtaatatacctgagttgttttttggcatgatgatcagaatcttacattactcagaaaacatctgtcctgcaatagtcagtactattgtgttgtaagtctcctctacagagtaacttgcagcagttccttagcaataagtatgatagcaaataaatagcaaagaatgtttccattctaaatctaaaactaattagattcaatcatcattaggcaatgacttcattaggcaatgaagattaacaataggtaattgttaatcttcaaaatctatcaatttacacctatttaaaaattggcatttaatgactgccatttgatgggtttggttaatattctgttcttggccgggcgcaatggctcacgcctgtaatccaagaactttgggaggctcaggcgggtagatcaattgaggtcagaagttcaagaccagcctggccaacaaggtgaaaccccgtctcaactaaaaatacaaaaacattagccaggtgtggtggcacacacctgtagtcccagctactcaggaggctgaggcaggagaatcgcttgaacccaggaggcagaggttgcagtgagctgagattgcaccactgcagtccagcctgagcaacagagcgagagtcagtctcaaaagaaagaaaaatattatgttctaattaccttgaaagaggaaagaaaggcttgaattgatcaataccagtttgaataagatacttatgtgaacaagcattctcaacattattattaaagtaaaactactcagtttacagaatgggatctgaaactacagctttttgctattaaaccaaatacttgtgatctactttgtttgagcaaaacagcattatttgttatgttaatgatggttaatttccattttattggttttatgtttattttaatttgtaaatgttttagcatttattattgtatgtgaactatatttacctattttatgttgataaaaatataaaaaatattaaaataagtatatattaagtt

SEQ ID NO: 334687 - DNA, 2879 bp, Homo sapiens
ctcatttttttttttaaaaatcacattatctgtatttccagacataaggtaagtatttcaccaactttcatccaaactaacatcctcaattgtaatcccactaagaaccgccagggcgagacgaaagcggaatcgcttccatctttacgtggagtccgggaaatggttcagcaccatgacatccgccgaagacgtaggtgtagacgaggaacaaaagagaagacccctcgtggaggtggcctgtggggcccgccctcaccgggcgccatctgtccctgattctgctccccgcaggggccgcagcgggtgcgcccggcgatagagcgggctgtggagggagcctccatggagtctccatcaaccattccggaccaggagacggtggcaggcagtaaaaaggcctaggcagggccagcgccccgggctgctagcacaggacggcggcgcccagggacgccccagggcaggcctcagcccctccaacccgcgagagcccagctccaagggagcctgcagctccctccatcttggttgatggaggcggggatctgcgtctgggtgtctccaccgtcgcgcccgaccagtactgccccgcggacgcagacgccggcagctggggctgttcccttgtccgaatggcagagcccagtcggggcttccgggacaagtcctggccccacggggtttggttttgaggggtcccaagttcccacagttgtcccgacaaaatggaggacgtcgtctcctcctgctgcagccatggcgggaggtgggggactattccccacggggcgcggcgagggtggaagggcctccactgaccgcagcgcactcaagactccagttcaaccgcggccccgaaagctcacttggccccgctccagcacctccccggcctcgcccctcttgggggccttcaaggaactggacagggagggcgctggggcatccaggccgccgctctcctcgagcagaggcgttgggagccgctgccgcagcttgggcccccgggctcgggcgagggcaggcggccccgccggagtctcccgggctgtgtaggtcccggagagccccgggccccgaggggccgaagcgggccgctacgacgggcggcgaatctcgggctcctgacctggcggacccggtagctgggggcgggagaccggcggggagacaacccgaccgggagttgagggctggcaggcgggagtggaactgcagggccgcgggtgtggcccgcacctgacggacagctcttcggccaccccaccgagggggcgccctgaaggacggccgtcggagccaatgggcgtgcccaaggcgcccaggctcgtctccctcgccagccaacgagcgcacggagggtggggcctcctcgggctctgctgcgccgtcccctgcttctccgcctcctcaccagcgcgaaaagccgggactggacctagcggagttgtgcttgtcgccgaagcggggtgggcttgttcgttccgcgcagccgcagccagaaccgggtgacgcttatccccgctgtctttccagtccagggccgctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaaggtaaatgcaggaatgggtaatagtggtatcactacagaattgactctgaaatacattattactaatgttacaaccttagaaacaggtataagctctgtgaatgctgggcaagatgtgaacataattattacatataaaacatcactatagaataccaacttgggagatgtcgctaaaggacttcagtcaagtaattttggtgttaatatacaaacgtacaccccatctttaactccacagaccaagactggagtaagaccttttaaccctggtagaatgaatgtggcaggagacttatttcagaatggagaatttgcaactcatcatagtcctgagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagaggtctggatttttatacctaagttgttgtttaggctaacagtgataattttaacttttaagtgctattatgtactctttcatctacataatgcacgtgttctggatgtataacatgaagctgaaaggaagaataaggatatgttagaactatcttatgggatattttataaataaaattccatttgcatagcatggaaagtac

SEQ ID NO: 334688 - DNA, 663 bp, Homo sapiens
agacggggtttcactatgttggccaggctggtctcgaactcctgagctcaggtgatctgcccaacttggcctcccaaagtgtgggattacaggcgtgagccaccttgcccggctgtattatcagttctttagtctataatgttgcccatttaggctctacagatatattaaaaatattcgttgatgaaataaaaaccaggaggtaataagaaagcctgtaatgtaaaggtttcccatttcttgtgaaagtagctgtggactttacccacagttattgctgcatcacattctgtttgatataatttttatttcatctacagttgtgccataatcaccaaattcccaaagtaaaaatatgttaggtttatatcattatttaaagatactttaaattttattttcctaaattaaattttcaacttgaaatattcttttgtaacagaaggaagaaagtgccattgtattttcactttgggccactattttaaaatattgggcaaacaaagtaacaataaaaattaaagctgagaaactatggcaaagacaaagtaagacaaagaacactgacttagattctgagataaaaagccagtttttgtttgtttgttttatttgagttctggtatacatgtgctgaacatgtggatttgttacataggtaca

SEQ ID NO: 334689 - DNA, 738 bp, Homo sapiens
ggccatgggtctggatttccaagaaagcggagacctcgaggtgcaggactgtcggggcgaggtggccgaggcaggtcaaagctgaaaagtggaatcggagctgttgtattgcctggggtgtctactgcagatatttcatcaaataaggatgatgaagaaaactctatgcacactacggttgtgttgttttctagcagtgacaagttcactttgaatcaggatatgtgtgtagtttgtggcagttttggccaaggagcagaaggaagactacttgcctgttctcagtgtggtcagtgttaccatccatactgtgtcagtattaaggtaaacatccttaaattgagttaacaaatatgtactgaatttttatttggttttagtagtaacatgagctcccagttctcacaattaagtattatgattattaaacgtatgtgacagtatttaagcactttaaatactgcttttaagggtttcctatctcaagaaatttgctcctctataaatcttatattgtactaatatcctgcttttgtcttgaaaaagtaaaacataaaaatatatgcatttaatttaaaagacaatttatactattcacaaagattttaggtttagctgattcattttgtctgttgatttaaaaagctgagaactggagtatttagtaaaaaattattagcctattctgttctttaccgcattctctctcctctgtgctcactcatatacaaaatgaca

SEQ ID NO: 334690 - DNA, 324 bp, Homo sapiens
tcaagcacaaattatcttaatttctaagctgggcctgcagattttctctaaatctgtacctcttcattcctcctgttatttagatcccttagacatgtgtgctgttgatccctcgtacttgttttcttcaggactttacgccgtgaagtgacctgttctccccctatatctctctatatctttagtctccaactctttagtgactttttcctcagcctgtaacattttccttcatcctgcatttgcctttaactcctctcttacatctctcttttttacttagccaagcttttagtgtccgcataagcttccattcaccagggc

SEQ ID NO: 334691 - DNA, 1171 bp, Homo sapiens
  misc_feature (1)..(2): n is a, c, g, or t
  misc_feature (6)..(8): n is a, c, g, or t
  misc_feature (10)..(10): n is a, c, g, or t
  misc_feature (12)..(12): n is a, c, g, or t
  misc_feature (14)..(15): n is a, c, g, or t
nncacnnncncncnnccccaaccccctcaatccccctttctctcctcatccttttcccctctttctccctgcctctttttggttatgccaggcaatatctaatctgcattttagcaagtcattcctgacaaatggaaaggtgaatgctcttccacagttctccctggcaaggcaatttttcttgttagcatccttctgtacgctccattaccctttttcctttatgtataggttaagaggaaatgatgaggctctgatttatcaatgagaaatcatttacactgtaggacattcaaatcctttagtctcagacttaagatcagtttcactccaggtttctatgctctgtggaaatttcatcactggacagtgctttccttttaaggaggttgccctttttttgtgttctctcttctcttcctctcccagtaaccaccggagggcgagagagccagctagttatcaggatggaggcatcattttaggagctggaatcctgtttagttatataatgccctgcagtgctgtttggaaggagggaaacctgtagggatattttcccattgggacccagaggaaagaagtttcaaatatatcttttcaaagtaatttttcaccaaatctgagtttagaaaatttcaacaaactccttcctcttttggaaaagcggagaagcttttgaaatgtttctcttccatgtgttatcccctcatcatcagtctaattacctcttttgaaatactgctttatgctctcggccttagcgccatttttttggaaacctctgtgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaatt

SEQ ID NO: 334692 - DNA, 1734 bp, Homo sapiens
  misc_feature (1)..(2): n is a, c, g, or t
  misc_feature (6)..(8): n is a, c, g, or t
  misc_feature (10)..(10): n is a, c, g, or t
  misc_feature (12)..(12): n is a, c, g, or t
  misc_feature (14)..(15): n is a, c, g, or t
  misc_feature (1207)..(1207): n is a, c, g, or t
nncacnnncncncnnccccaaccccctcaatccccctttctctcctcatccttttcccctctttctccctgcctctttttggttatgccaggcaatatctaatctgcattttagcaagtcattcctgacaaatggaaaggtgaatgctcttccacagttctccctggcaaggcaatttttcttgttagcatccttctgtacgctccattaccctttttcctttatgtataggttaagaggaaatgatgaggctctgatttatcaatgagaaatcatttacactgtaggacattcaaatcctttagtctcagacttaagatcagtttcactccaggtttctatgctctgtggaaatttcatcactggacagtgctttccttttaaggaggttgccctttttttgtgttctctcttctcttcctctcccagtaaccaccggagggcgagagagccagctagttatcaggatggaggcatcattttaggagctggaatcctgtttagttatataatgccctgcagtgctgtttggaaggagggaaacctgtagggatattttcccattgggacccagaggaaagaagtttcaaatatatcttttcaaagtaatttttcaccaaatctgagtttagaaaatttcaacaaactccttcctcttttggaaaagcggagaagcttttgaaatgtttctcttccatgtgttatcccctcatcatcagtctaattacctcttttgaaatactgctttatgctctcggccttagcgccatttttttggaaacctctgtgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaataaaaaaaaanaaaaaaaaaaaaaaaaaaaaaaaaaaaaaaaaaaaaaaaaaaaaatggtggcccctttggcccaatcgactttaaaatcgaccaagtttatgcaaggggcccaaattcgggctaaattggccaattcgccctaaaggggggcgaattaaaaataaagggcccgcgttttaaaacgctcggactggaaaaaccctggggttccccaacttaaaccccttggaaaaaaacccccttttccaaattggggaaaatgcaaaaaagccccaaccgaacccctttccaaaaaattgccccacccaaatgcgcaagggaaattgtaaggcttaaaatttgggaaaaaatcccgtaaattttgggaaaacaactaaattttaaacaaaaggcccaatatgggaaaaatccctttataactgaacttccctcataaagggttgagggttgtccaatttggaacaaagaccctcttataagaaagggcctcaaacgtaattttttgggctaagggccaataccctttggccctggcc

SEQ ID NO: 334693 - DNA, 1278 bp, Homo sapiens
  misc_feature (1)..(2): n is a, c, g, or t
  misc_feature (6)..(8): n is a, c, g, or t
  misc_feature (10)..(10): n is a, c, g, or t
  misc_feature (12)..(12): n is a, c, g, or t
  misc_feature (14)..(15): n is a, c, g, or t
nncacnnncncncnnccccaaccccctcaatccccctttctctcctcatccttttcccctctttctccctgcctctttttggttatgccaggcaatatctaatctgcattttagcaagtcattcctgacaaatggaaaggtgaatgctcttccacagttctccctggcaaggcaatttttcttgttagcatccttctgtacgctccattaccctttttcctttatgtataggttaagaggaaatgatgaggctctgatttatcaatgagaaatcatttacactgtaggacattcaaatcctttagtctcagacttaagatcagtttcactccaggtttctatgctctgtggaaatttcatcactggacagtgctttccttttaaggaggttgccctttttttgtgttctctcttctcttcctctcccagtaaccaccggagggcgagagagccagctagttatcaggatggaggcatcattttaggagctggaatcctgtttagttatataatgccctgcagtgctgtttggaaggagggaaacctgtagggatattttcccattgggacccagaggaaagaagtttcaaatatatcttttcaaagtaatttttcaccaaatctgagtttagaaaatttcaacaaactccttcctcttttggaaaagcggagaagcttttgaaatgtttctcttccatgtgttatcccctcatcatcagtctaattacctcttttgaaatactgctttatgctctcggccttagcgccatttttttggaaacctctgtgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaacctggctaacacagtgaaaccccgtctctactaaaaatacaaaaaagtagtcgggtgtggtggcgggcgcctgtggtcccagccactcaggaga

SEQ ID NO: 334694 - DNA, 1309 bp, Homo sapiens
cagaaaagaaagaaagaaaagatccctttgctatgagctcgctgtatattgataagtgtaagaattgtgttgcatgaataaccgctttgggctggatttgaagtattttgatgttgtgttttgcaaatattgaagttacaataatggcaacagaaaaggaacagatacacagctttacacttagcagaatgttacatttaaaatctgacaaggcgccaagatggtgactgtctcctctaaaccacgaaagagtaagatttgtgcaaccctcctcctcttccacctccttcaggagaattaaatgaatcaagactttggaaagacggggaagagccgggacttggcagtacttgaaacaggaggaatacaccagcctaaatgtacagactttgtagccgagcccactcgatcggtctgtgccttcacgtgaccaccatctgtgcctccctcgctccatccaaatttgtgtaggctgctccttggagctatgcctaaaatatagctacaccagagccctggaaactgtagtcaagtaacaggcctcactgttttttttctttggattaaaagtgtatatctctctactgaggggtttccagctttacacttctataggttgttctgacagtgagaacacattatgtacatgttttctattcatgtccagggcatgagaatcttaatattcttatacttccctttttgcatgcagtatgtctggaatatgtttataaaattttagcaaggggtgagatcaagggacaaaggtagagtggttatttaaagacaatcagaaatgaacttaaaagctgccctgcaaaaccaatcctttcctatcatgaagagtaccttcatattttctagagattgtctctgaaccgttgctacatagccataaatttctgtaaatcatgttggctatcagttcttgctattctcagagcactctatcatgtttttaggtgtatattgtgtattcaggatagcattaaaaagaactgatggcaaatgtattgactcacagtggaaacattcatttggatgaagaattagtggtttagcctttgaaatgaataccttgaatcatttcttctgattttctagtagtttattatctcaaatgattattatccccttcaaaaatactggtctgtactttggtgttgtggtttcatttttctggcattgatcaaatagcaaatacaaaataaagcatttctacatgtttgaggtggttgtttttaaaggggatatgtgtaatgcagattttctttattaataaaattttcataatctctgaaaaaaaaaa

SEQ ID NO: 334695 - DNA, 1078 bp, Homo sapiens
cctaacaggctttggagccggggagaggcgaggagagggaagaagaggagaagaaaagaagaggaattaaatgaatcaagactttggaaagacggggaagagccgggacttggcagtacttgaaacaggaggaatacaccagcctaaatgtacagactttgtagccgagcccactcgatcggtctgtgccttcacgtgaccaccatctgtgcctccctcgctccatccaaatttgtgtaggctgctccttggagctatgcctaaaatatagctacaccagagccctggaaactgtagtcaagtaacaggcctcactgttttttttctttggattaaaagtgtatatctctctactgaggggtttccagctttacacttctataggttgttctgacagtgagaacacattatgtacatgttttctattcatgtccagggcatgagaatcttaatattcttatacttccctttttgcatgcagtatgtctggaatatgtttataaaattttagcaaggggtgagatcaagggacaaaggtagagtggttatttaaagacaatcagaaatgaacttaaaagctgccctgcaaaaccaatcctttcctatcatgaagagtaccttcatattttctagagattgtctctgaaccgttgctacatagccataaatttctgtaaatcatgttggctatcagttcttgctattctcagagcactctatcatgtttttaggtgtatattgtgtattcaggatagcattaaaaagaactgatggcaaatgtattgactcacagtggaaacattcatttggatgaagaattagtggtttagcctttgaaatgaataccttgaatcatttcttctgattttctagtagtttattatctcaaatgattattatccccttcaaaaatactggtctgtactttggtgttgtggtttcatttttctggcattgatcaaatagcaaatacaaaataaagcatttctacatgtttgaggtggttgtttttaaaggggatatgtgtaatgcagattttctttattaataaaattttcataatctctgaaaaaaaaaa

SEQ ID NO: 334696 - DNA, 1397 bp, Homo sapiens
cagaaaagaaagaaagaaaagatccctttgctatgagctcgctgtatattgataagtgtaagaattgtgttgcatgaataaccgctttgggctggatttgaagtattttgatgttgtgttttgcaaatattgaagttacaataatggcaacagaaaaggaacagatacacagctttacacttagcagaatgttacatttaaaatctgacaaggcgccaagatggtgactgtctcctctaaaccacgaaagagtaagatttgtgcaaccctcctcctcttccacctccttcaggagaattaaatgaatcaagactttggaaagacggggaagagccgggacttggcagtacttgaaacaggaggaatacaccagcctaaatgtacagactttgtagccgagcccactcgatcggtctgtgccttcacgtgaccaccatctgtgcctccctcgctccatccaaatttgtgtaggctgctccttggagctatgcctaaaatatagctacaccagagccctggaaactgtagtcaagtaacaggcctcactgttttttttctttggattaaaagtgtatatctctctactgaggggtttccagctttacacttctataggttgttctgacagtgagaacacattatgtacatgttttctattcatgtccagggcatgagaatcttaatattcttatacttccctttttgcatgcagtatgtctggaatatgtttataaaattttagcaaggggtgagatcaagggacaaaggtagagtggttatttaaagacaatcagaaatgaacttaaaagctgccctgcaaaaccaatcctttcctatcatgaagagtaccttcatattttctagagattgtctctgaaccgttgctacatagccataaatttctgtaaatcatgttggctatcagttcttgctattctcagagcactctatcatgtttttaggtgtatattgtgtattcaggatagcattaaaaagaactgatggcaaatgtattgactcacagtggaaacattcatttggatgaagaattagtggtttagcctttgaaatgaataccttgaatcatttcttctgattttctagtagtttattatctcaaatgattattatccccttcaaaaatactggtctgtactttggtgttgtggtttcatttttctggcattgatcaaatagcaaatacaaaataaagcatttctacatgtttgaggtggttgtttttaaaggggatatgtgtaatgcagattttctttattaataaactcttggtggtgtctgatacccaattcgccctataactagtggggtggccctttactgaatgcggcttatcaacagtcggactgcaataacctggccgttacccaacttcatcg

SEQ ID NO: 334697 - DNA, 194 bp, Homo sapiens
tgtaggtccatgagaagggttgagtctgaggtgcctgtgagacacccaagtggaaatggcaagtcagtggccggaagagcaggtctagagtccaggagccccacaaggtttgaaaggaccagttgtgcatcatgtgagtgtaactgataataggtactccccagaagtgtgtgccaagggtcaagagcgtggac

SEQ ID NO: 334698 - DNA, 1756 bp, Homo sapiens
atttccacatcttggctattatgagtaatgctacaacgaacgagggagtgaaaatatctctttaagatcctgatttcagtttttttgaataaatacccagaagtggaatgactgggtcattcatatggtaattctaattaaacatagaattatttttaattttttgagaaacttctgtgctgctttccacagtggttgcatctgtttacatacttaccaatggtgcacaagggttccaatttctccacatctttgccaacttgttatctgtgtttgtttaaatgacagctgtatgagttgtcccttgcctccatgcaattctgaacttcagaaataagcacttggctcctttaatagctgtccgtcctatgttgtgtctacagccactgaatcctgtcctacattttctgattcattaactcattcaactaatagctattgaacaccatcaataagtcagccaccatgaagatgagtattttatattgaattctactaacatatcctgtatgtttactatgttgccagagaggatgctgtgtgctttttttacattgttatctttactcttcacaagaaccatgtaaggtaggtattggtaaaatgggtaattttggaaatgcttcaataatcgagtagaataacttttgctctatgtgagaagatacgttttaaataagatatggcttaggtttctggttacctgagacatactataccttctcagatactctcagacctgaatcatttaacaaactaaggcagaaatactaaaaatatctggttcaataacataggggcatggagtagacatgcagaaaatgcttgttcacttgccttgaaatggctccaggtggcctgaaggaatcaatgaaacttctcaagtatctacattacaaccactggtccccactacacatttatttctaaataaaggaggagaaactctagcaaagtaatatttaacattttcattgcttccaggataaatcttattgaatatggaggatctgatagtggtaggtctatcaggaatatcagggaaaatgcttttgatgttgttggcaaagtcaattcctatcatttgtacttgacaccagctacctagcaggctcattgtgaacttcaggtttcgcccacgttatttatataaagtatctcagtgtaatatagggagttgctggttatttgaaaatagtaacaaaaataacccaaacgagaaactccatttccataattagctttcctgaaagtcaggcatgtctttgaggacaggttttggcagtattatttttgtgcacaggaggaaaattgttagtaggtttatagatgttatttttataatagaatgttaaacccctgaaaaacatcaaaaattgtctcctagaactaattctatgttttaaaaacttgttttaaaaaggattctaaatagcaatagggtctttcctcctttctccactccaatggtttaatgggatagaggaatcaatgtttatatttttaaacctgtaaatattttattttgggtattttgtatatttgttgatataattccattttgtgcatatgtaccattgtgcatgttgctgtttttgatagtcactcttttaatgaatgtaagaagcttgggctaatagcacttttcttgttccattcaaacatctgaaaatgaaattacaacactgccattttactgttgtgtttaattcagtcaataaattttgttgctcctttgcatttaaaatgaattctg

SEQ ID NO: 334699 - DNA, 151 bp, Homo sapiens
ataagagagtaattatatctggaaaaattaaaaaaaggaggaatgtcagagaaaatacaaaaaggaagtgacctgagctgagctttgaaggatgaaagcaccagttacacatggaggaagaggcattccagggcagaggtgacagagtgaa

SEQ ID NO: 334700 - DNA, 156 bp, Homo sapiens
ccatgtgctcagaatatatagtagctaacaggaatttaatgattttttaattattatagtttccagtgtatttctttatagggttaacctctattatgccgagtaatgctggtttccaattaatgctgtctctttttttttttttttttttttttt

SEQ ID NO: 334701 - DNA, 313 bp, Homo sapiens
gatgggggatcaggaagcaggagcctctgaggacgagggatcaggaaggaggagcctctgaggacggcggatcaggaaggaggagcctctgaggacgaaggatcgggaaggaggagcctctgaggacggcggatcgggaaaggaggagcctctgaagatgggagattgggaaggaggagcctctgaggatggggaatcaggaaagaggagcccccctgagaccaggggatcagggaggggggagccagggttcctgatggctctgggaccagggcaaggcaaaggagctgctgcctctggatggtcctccatg

SEQ ID NO: 334702 - DNA, 515 bp, Homo sapiens
catattgtccaggttagttctctatggcagaagaggtaaggctggagatgaagaaaatttgtgatctggaagtacctggcaatgcatcatccactaacttaataactttccttactggttttgagggcctaagaacccgtttttagtgtcccccagctctatttgaggaacttttattctttgacgtgtcactaattccatactttactatggaaaattgcctgttgaaatcatacaagtcatcagcatatggtacttacaagataggcctcccacccattcataatttaaacaactattatgtattaattataggaaatttggaaaatagatatttaaaggaaaaaagaagtaattccacttattcaggatgaccattgttaatatttggaacatgtagccttttgatacacatttagtatacatacattaaacatataattgaaagtaggccacctctggtattttgtaatattaagattaatattttaaaacttaatattttttcatatttc

SEQ ID NO: 334703 - DNA, 166 bp, Homo sapiens
ccttgctcagatgtccatcctgtttcctcagctttgcctcctcaaccatgagggttctaatcttcatagttgcttctgtttgataagttctatttatttaggaagccatacacaggaacacaggcagaagagaaccagaagactgcatccattggaaaatttaata

SEQ ID NO: 334704 - DNA, 399 bp, Homo sapiens
tgtgtgcctcggcctttcccaagggccagcttcttcctggtagtgcttttgtgtacttgtctggttgggacttcgtgtttctttcttgggattgttgtctgggactgcaagcagggtatgtttttatctactgtgaggttcctggggcggagatgtgcagtggagcgagaacttcctgtgaccgtgacattgtctaggtggtgagcaggtgtgggggtgtggagagaggtgaggggctgaggtagtgctgagtggggaaaaagcacctcccaccacaagctgttctgtcccgctccatcctctgcccagtagctctctcagttgctttgcctactcagtctcactgtttcatcttccctgggtctcttggtccccttccttttgactgtgtgtgatttt

SEQ ID NO: 334705 - DNA, 143 bp, Homo sapiens
tttgactgccaatatacagtgtgctgcttttgttgaaacttgtagctctcacactggtatttgccaacattacatttgacttctcacatagtaaaagacaactcattcctgtggagtttaaggcatgtggaaacatctatctg

SEQ ID NO: 334706 - DNA, 310 bp, Homo sapiens
gatgctcttcagaggggacactgccaaactgtgtccaggttaaggggataaagaaggatcctatggcacacagaaatgataccacctgggtgccatggggatgctgaacccgtggcacagaagggaagggagaggtgacagcaaatgctcacagagctgccatgtggaggaaggtgaactggagtgcctgaagggtgagatactgcagggtgggaacatctggcctattatggacagagtttttatcacaacaaagaattgggaaacaagtgagtaagtgacctgtgtgaggagggaactattcgcccag

SEQ ID NO: 334707 - DNA, 1679 bp, Homo sapiens
cactccatgccctgtgaatgaaacagatggctttcctgacctctaatcaaagcctacccatattgatctgttccttctagtccttagtatgtgctacctcttcttttctgtgccgaagtggtgagtagccaatagttatttcctctaccagtggtattttactaggcaattattggaaatagaatgctgccacccggtagtgataaatctaacatttctcgtagaagatataggtggattagttactccctggggcaatatggattagttcctgtgtccttcaaattgcactcaccaagcctgagccatgctttactgctgaaacatcctagcagagagaagtaagtggctcagggtggccctcttgtggtggacaagcattcccaggactctgctggtcactaaagaaaaggtagccctcaaacagtcctttttattatttttgattttattgtcatcattatcagtatcctccaagtcaagaatccgtaaataatacaatgagatgctaaaaacaagtttgaaaaatgtgagcaaggtctgtttctagttttaaaatagcccacatttctcaaatatgttactgtttggttcagaatttggaccactacctaaaaagaacagatcattcaaacgtgtcttttgaatatttctgtcatctggaaatgcctgcgcataagccccatgacggatgtgcttggctaaaaaacctgttgacgtgtcctcagccttcagaatagaagagacagccagtttcccatgattctaaggataaacatcccccactggaaaaatattacattagctggcaagtaataatccaaacatgtacatggatagtaaatattctgtgtgtgatcctcataattttatactccaaaacagtattttaggaggatcaaaattatatttattaacacacagttgaaattgccattctagaactcaaataacacaggaccaaatttgacagaatcagctgtggaactttatcaaaagtctgaagccaggacctcaccactggatggtctgagtcagaagtctggggagagttccagcattactatttttctttttcattctctgtgtgattatagtatgcagctaggactgagtgagagtaacactaaaccgtgatctccttggtggaatgctgtgggtactcctaggagagactctccaaatttgtgaatttataccagtgtagtgggctactcagaatgcaaacagtcacgctacatgtcacatttcagggaatcttcagagctgaccagacctgttgaagacaaggatttcttcctcttctttgagtcctcttggtctaacctggcacagaattggtattcacaaatatttgttaaatggaatgttaattgaagtacccaagaccttaggaattgaagataatttaagatttaagagttctgctaaacaactgagatctcatgatcttaaagtactttgaaaattgcaaggggcagacattattcaagaaggaaggatttcttaaaatacgtcctttatagtagcctttgaactttaacatgcagaagaatgagtttaggcggggcacagtgtttcaggcctataatctcagcactttgggaggcaaaggagggaggatcatttgagctcagaagttcaaaaccagcctgagcaacatagcaagaccttatctc

SEQ ID NO: 334708 - DNA, 1471 bp, Homo sapiens
cagttccttaaagatactggtccactgtcttctggctttcattgttttggcaagaagtctttttaattttattgttcttgatgtaatgtgtttttttctgactccttttaagatttttctcctcttccccccatctttccatgccaccacagtggtgcatgtcacgagcgtccatgtgaagagaccaccaggcaagctttacgtgaacagtaaagcttttttatttcacctgggtgcaggcggactgagtccgaagagtcagcaaagggtgatgggattatcattagttcttataggtttgtgataggcggtggagttgggagcagtttttttgtgggcagggggaggatcttacaaagtaccttctcaagggtggagcgggtgtatcgtacaaagtacattcacaaggacgggggaatatcataaagtacataagcgcaagggctgggagggggtgtattgtcacaaagtcaattgatcagtcagggtggggcaggaacaaatcacaatggtggaatggcatcagttaaggcaggaactggctattttcacttttgtgaatcttcagttgcttcaggccatctggatgtatatgtgcaggtcacaggggatatgacggcttaacttgggctcagaggcctgacagtgcacacggatgtcctggctgacattctcaagagcatcaacaatgccgaaaagaggcaaacgctaggtgctttttaagctgtgctccaaggtcattgcccgtctctcactgtgatgatgcagcacggattatgcggggtggagttggggggacttcctgggccgggggacttttgcaagagaccccggtgactcaggattttgagttcttaaccagtcgagtgaaggattcaaaattaaccactccaagggaggattgaaaaaagaaccactctcagtggacaaaaagaaagaaaggggagagggtaacacagggatataagccctagtcacccgagccagcaacggcaacccttctgggtccccttccaccacgtggaagctttcctttcactttgttcagtaaactgcgctgctgctcactctcctggtccgtggactctttttaagctgtaacactcaccgtgaaggtccgcagcttcattcatcaaagttagcgagaccacaaacccatcggcaggaaaaactcctaactcagttacattggcaaatttgaaatcattgatgatcacagagctgggaaaattgttgtgaacctcacaggcgggctaaacaagtgtggagtgatcagcctcagatttgatgtgcaactcaaagatctagaaaaatggcagaataatctgcttccatcctgccagtttggtttcattgcactgacaacctcggctggcatcatggaccataaggaagcaagatgaaaacacacagcagggaaaatcctggaattctttttctagggatgtaatacatatttacaaaaaaaaaa

SEQ ID NO: 334709 - DNA, 654 bp, Homo sapiens
tgcttaagaaaactttgctgctgtgtaatattagaacggaaggttggtttccagtaaaatgcattaactttggctcaaaccaagatgatgggtaccgggcatgggggtggggaggcagttgaagatccactgagctttgtctcagggcagccctgctcatcgtcctactttaccttccaccacggtgctcaagcccacactgagagagaaatttccagctgcaaaagggagaagagaaacgctggaatactagtatcggacgttaggacatggttgtggtgttttaaaaatcatttcatcatctggagtttgaccccgaggggagtattttcacccttcagccctctgaaagcattcactagcatctgaatattgttctgagtttgttggagcagtgaaatctggtgagagagaagggtggaggaaggaaggagctgttgtatttggcggctggactcaggtagaggaaactgctacaatcccgggaaagaacagaaaagtagaaagggacgagttcccacacgcagccaatgtccatggccttaactgtgcttgggaaggaagatcctgggccaggggtgtaccctcgtttttcaaaactaaacgtgtctgagacagctacaaagtttattaagggacttgagagactagagt

SEQ ID NO: 334710 - DNA, 1618 bp, Homo sapiens
catataagacatgaattccatgagtaaaatcaaacttctgtggcaaggaaacctctctgagtctcgatttcctccgtggtaaaaaggagagggttaaaccacagggtcccgagggtcccttccagctgtcacattctggagcgtatgagatgagattcttctactcaaaacaaaagagccaacagaacagaagaaaatgtttcagacggttccccaaatgccggttctgtggagcagacgcccaagaagcctggcctcagaagacgtcaaacgtaaacagctcgaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttaaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagcta

SEQ ID NO: 334711 - DNA, 2452 bp, Homo sapiens
atcattttcttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggccgcgtaggggcgctttgttttgttcggttttgtttttttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacgattcttctactcaaaacaaaagagccaacagaacagaagaaaatgtttcagacggttccccaaatgccggttctgtggagcagacgcccaagaagcctggcctcagaagacgtcaaacgtaaacagctcgaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttaaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagctattcattgagtcaaattgtaatgtgctttaccaa

SEQ ID NO: 334712 - DNA, 463 bp, Homo sapiens
taggaggctgtcctgtgtgttttagattgtttggaattatccctggcctctcacactagatgccagcagtatcctcctcccccagtgtgacaacctaaaatgtctccagacattgccaaatgttccctgtggggcgggggcaacattgcctactgttaagaactactgctctagaccaaagaacacagcacagaggaaaggaaaaaaaaatccagttaagagaatgttaggtggagatgactatagtcatcaaacttttttccccatcaagtatttccaagctaacatagtgacaaaataattcctgtactctactggtaacgttaatctagtgctcttcctttaattcttccgttttgttttcttttgcagaattaagaatatgtttccttgtttatcagatacatcactgcttgatgaagcaaggaagatatacatgaaaattttaaaaatacatatcgct

SEQ ID NO: 334713 - DNA, 443 bp, Homo sapiens
ctgggaaggagccattttcagtcacttgtaagacagcaggacctgcagactacagcacaatcaaactcagacaaaaccctgaaccagtgagaaccattaggaaggaaaggaacagaaaatgaaccaacctgagtgttaggagacttgcatctagtcctgactccggtaccaaccgaatgcatgtccctggacaggaaacctctctgagtctcgatttcctccgtggtaaaaaggagagggttaaaccacagggtcccgagggtcccttccagctgtcacattctggagcgtatgagatgaggtaggcacacaaagtggacaagatgtggctaagaaaacaagctacacatcaagctcatctgtagcataggtgcttaagaaaactttgctgctgtgtaatattagaacggaaggttggtttccagtaaaatgcattaactttg

SEQ ID NO: 334714 - DNA, 2419 bp, Homo sapiens
atcattttcttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggccgcgtaggggcgctttgttttgttcggttttgtttttttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacgattcttctactcaaaacaaaagagccaacagaacagaagaaaatgtttcagacggttccccaaatgccggttctgtggagcagacgcccaagaagcctggcctcagaagacgtcaaacgtaaacagctcgaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttaaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagcta

SEQ ID NO: 334715 - DNA, 2725 bp, Homo sapiens
gtctttatttcagtcccggatccgcgggcgcaggcccagctcaggcccccagggatggacgtcgtggaccctgacattttcaatagagacccccgggaccactatgacctgctacagcggctgggtggcggcacgtatggggaagtctttaaggctcgagacaaggtgtcaggggacctggtggcactgaagatggtgaagatggagcctgatgatgatgtctccacccttcagaaggaaatcctcatattgaaaacttgccggcacgccaacatcgtggcctaccatgggagttatctctggttgcagaaactctggatctgcatggaattctgtggggctggttctctccaggacatctaccaagtgacaggctccctgtcagagctccagattagctatgtctgccgggaagtgctccagggactggcctatttgcactcacagaagaagatacacagggacatcaagggagctaacatcctcatcaatgatgctggggaggtcagattggctgactttggcatctcggcccagattggggctacactggccagacgcctctctttcattgggacaccctactggatggctccggaagtggcagctgtggccctgaagggaggatacaatgagctgtgtgacatctggtccctgggcatcacggccatcgaactggccgagctacagccaccgctctttgatgtgcaccctctcagagttctcttcctcatgaccaagagtggctaccagcctccccgactgaaggaaaaaggcaaatggtcggctgccttccacaacttcatcaaagtcactctgactaagagtcccaagaaacgacccagcgccaccaagatgctcagtcatcaactggtatcccagcctgggctgaatcgaggcctgatcctggatcttcttgacaaactgaagaatcccgggaaaggaccctccattggggacattgaggatgaggagcccgagctaccccctgctatccctcggcggatcagatccacccaccgctccagctctctggggatcccagatgcagactgctgtcggcggcacatggagttcaggaagctccgaggaatggagaccagacccccagccaacaccgctcgcctacagcctcctcgagacctcaggagcagcagccccaggaagcaactgtcagagtcgtctgacgatgactatgacgacgtggacatccccacccctgcagaggacacacctcctccacttccccccaagcccaagttccgttctccatcagacgagggtcctgggagcatgggggatgatgggcagctgagcccgggggtgctggtccggtgtgccagtgggcccccaccaaacagcccccgtcctgggcctcccccatccaccagcagcccccacctcaccgcccattcagaaccctcactctggaacccaccctcccgggagcttgacaagcccccacttctgccccccaagaaggaaaagatgaagagaaagggatgtgcccttctcgtaaagttgttcaatggctgccccctccggatccacagcacggccgcctggacacatccctccaccaaggaccagcacctgctcctgggggcagaggaaggcatcttcatcctgaaccggaatgaccaggaggccacgctggaaatgctctttcctagccggactacgtgggtgtactccatcaacaacgttctcatgtctctctcaggaaagaccccccacctgtattctcatagcatccttggcctgctggaacggaaagagaccagagcaggaaaccccatcgctcacattagcccccaccgcctactggcaaggaagaacatggtttccaccaagatccaggacaccaaaggctgccgggcgtgctgtgtggcggagggtgcgagctctgggggcccgttcctgtgcggtgcattggagacgtccgttgtcctgcttcagtggtaccagcccatgaacaaattcctgcttgtccggcaggtgctgttcccactgccgacgcctctgtccgtgttcgcgctgctgaccgggccaggctctgagctgcccgctgtgtgcatcggcgtgagccccgggcggccggggaagtcggtgctcttccacacggtgcgctttggcgcgctctcttgctggctgggcgagatgagcaccgagcacaggggacccgtgcaggtgacccaggtagaggaagatatggtgatggtgttgatggatggctctgtgaagctggtgaccccggaggggtccccagtccggggacttcgcacacctgagatccccatgaccgaagcggtggaggccgtggctatggttggaggtcagcttcaggccttctggaagcatggagtgcaggtgtgggctctaggctcggatcagctgctacaggagctgagagaccctaccctcactttccgtctgcttggctcccccaggctggagtgcagtggcacgatctcgcctcactgcaacctcctcctcccaggttcaagcaattctcctgcctcagcctcccgagtagctgggattacaggcctgtagtggtggagacacgcccagtggatgatcctactgctcccagcaacctctacatccaggaatgagtccctaggggggtgtcaggaactagtccttgcaccccctcccccatagacacactagtggtcatggcatgtcctcatctcccaataaacatgactttagcctctgc

SEQ ID NO: 334716 - DNA, 1028 bp, Homo sapiens
  misc_feature (926)..(926): n is a, c, g, or t
  misc_feature (955)..(955): n is a, c, g, or t
  misc_feature (959)..(959): n is a, c, g, or t
  misc_feature (962)..(962): n is a, c, g, or t
  misc_feature (997)..(997): n is a, c, g, or t
aaggcgggtgcagggcttctggggacggagggaggtgccagaagttgagccctgaggccctgctggcccctgggcgcaggcccagctcaggcccccagggatggacgtcgtggaccctgacattttcaatagagacccccgggaccactatgacctgctacagcggctgggtggcggcacgtatggggaagtctttaaggctcgagacaaggtgtcaggggacctggtggcactgaagatggtgaagatggagcctgatgatgatgtctccacccttcagaaggaaatcctcatattgaaaacttgccggcacgccaacatcgtggcctaccatgggagttatctctggttgcagaaactctggatctgcatggaattctgtggggctggttctctccaggacatctaccaagtgacaggctccctgtcagagctccagattagctatgtctgccgggaagtgctccagggactggcctatttgcactcacagaagaagatacacagggacatcaagggagctaacatcctcatcaatgatgctggggaggtcagattggctgactttggcatctcggcccagattggggctacactggccagacgcctctctttcattgggacaccctactggatggctccggaagtggcagctgtggccctgaagggaggatacaatgagctgtgtgacatctggtccctgggcatcacggccatcgaactggccgagctacagccaccgctctttgatgtgcaccctctcagagttctcttcctcatgaccaagagtggctaccagcctccccgactgaaggaaaaaggcaaatggtcggctgccttccacaacttcatcaaagtcactctgactaagagtcccaagaaacgacccagcgccaccaagatgctcagtcatcactggtatccanctgggctgatcgaggctgatctggatttnttgnaantgaaatccgggaaagacctcattgggaattgagangagagccgactaccctgtatctcgggataat

SEQ ID NO: 334717 - DNA, 594 bp, Homo sapiens
ctggccacagcccacaaggccatgacatctccagccaagtcccagcctttctcccacctcaaatcctttgcacaggctgttctccccagccagaacactcttccttgccctttcaccaagttccctcctaaccccccttcaggctgcaccatccattctctggggagtctgggctgacctcctgggttaggtttccctgccagacatgccatgcttttttgcactcatgtaattcactgattcatgttgatctccttctctagaatgcaagcttcctaagggcagggaccgtgtctgcccattcactgctatagttcagcatggggctggcacagtctctattaactactttgtgaattaatgaatcaatgaacatatgaatgaataaatgaactgacttatctcttccttccacaggcctgtagtggtggagacacgcccagtggatgatcctactgctcccagcaacctctacatccaggaatgagtccctaggggggtgtcaggaactagtccttgcaccccctcccccatagacacactagtggtcatggcatgtcctcatctcccaataaacatgactttagcctctgc

SEQ ID NO: 334718 - DNA, 2642 bp, Homo sapiens
aaggcgggtgcagggcttctggggacggagggaggtgccagaagttgagccctgaggccctgctggcccctgggcgcaggcccagctcaggcccccagggatggacgtcgtggaccctgacattttcaatagagacccccgggaccactatgacctgctacagcggctgggtggcggcacgtatggggaagtctttaaggctcgagacaaggtgtcaggggacctggtggcactgaagatggtgaagatggagcctgatgatgatgtctccacccttcagaaggaaatcctcatattgaaaacttgccggcacgccaacatcgtggcctaccatgggagttatctctggttgcagaaactctggatctgcatggaattctgtggggctggttctctccaggacatctaccaagtgacaggctccctgtcagagctccagattagctatgtctgccgggaagtgctccagggactggcctatttgcactcacagaagaagatacacagggacatcaagggagctaacatcctcatcaatgatgctggggaggtcagattggctgactttggcatctcggcccagattggggctacactggccagacgcctctctttcattgggacaccctactggatggctccggaagtggcagctgtggccctgaagggaggatacaatgagctgtgtgacatctggtccctgggcatcacggccatcgaactggccgagctacagccaccgctctttgatgtgcaccctctcagagttctcttcctcatgaccaagagtggctaccagcctccccgactgaaggaaaaaggcaaatggtcggctgccttccacaacttcatcaaagtcactctgactaagagtcccaagaaacgacccagcgccaccaagatgctcagtcatcaactggtatcccagcctgggctgaatcgaggcctgatcctggatcttcttgacaaactgaagaatcccgggaaaggaccctccattggggacattgaggatgaggagcccgaggaatggagaccagacccccagccaacaccgctcgcctacagcctcctcgagacctcaggagcagcagccccaggtcagggaccccagggaggatggggagggggctggaatgtggacaaggcccccaaggctcatacctgtcacccttcaggaagcaactgtcagagtcgtctgacgatgactatgacgacgtggacatccccacccctgcagaggacacacctcctccacttccccccaagcccaagttccgttctccatcagacgagggtcctgggagcatgggggatgatgggcagctgagcccgggggtgctggtccggtgtgccagtgggcccccaccaaacagcccccgtcctgggcctcccccatccaccagcagcccccacctcaccgcccattcagaaccctcactctggaacccaccctcccgggagcttgacaagcccccacttctgccccccaagaaggaaaagatgaagagaaagggatgtgcccttctcgtaaagttgttcaatggctgccccctccggatccacagcacggccgcctggacacatccctccaccaaggaccagcacctgctcctgggggcagaggaaggcatcttcatcctgaaccggaatgaccaggaggccacgctggaaatgctctttcctagccggactacgtgggtgtactccatcaacaacgttctcatgtctctctcaggaaagaccccccacctgtattctcatagcatccttggcctgctggaacggaaagagaccagagcaggaaaccccatcgctcacattagcccccaccgcctactggcaaggaagaacatggtttccaccaagatccaggacaccaaaggctgccgggcgtgctgtgtggcggagggtgcgagctctgggggcccgttcctgtgcggtgcattggagacgtccgttgtcctgcttcagtggtaccagcccatgaacaaattcctgcttgtccggcaggtgctgttcccactgccgacgcctctgtccgtgttcgcgctgctgaccgggccaggctctgagctgcccgctgtgtgcatcggcgtgagccccgggcggccggggaagtcggtgctcttccacacggtgcgctttggcgcgctctcttgctggctgggcgagatgagcaccgagcacaggggacccgtgcaggtgacccaggtagaggaagatatggtgatggtgttgatggatggctctgtgaagctggtgaccccggaggggtccccagtccggggacttcgcacacctgagatccccatgaccgaagcggtggaggccgtggctatggttggaggtcagcttcaggccttctggaagcatggagtgcaggtgtgggctctaggctcggatcagctgctacaggagctgagagaccctaccctcactttccgtctgcttggctcccccaggcctgtagtggtggagacacgcccagtggatgatcctactgctcccagcaacctctacatccaggaatgagtccctaggggggtgtcaggaactagtccttgcaccccctcccccatagacacactagtggtcatggcatgtcctcatctcccaataaacatgactttagcctctgc

SEQ ID NO: 334719 - DNA, 2647 bp, Homo sapiens
caggttccctggctcccatccaatgcctggcctggccggggtgacctttgcagtgacaggctccctgtcagagctccagattagctatgtctgccgggaagtgctccaggtaaggagaggcctggggattctggggatgggaggggagggtggccccactccagcccccaaacactcactgtccccttgtccacccttctccccagggactggcctatttgcactcacagaagaagatacacagggacatcaaggtggtctgggggtgtaggggtgctgttggggggtggggcccaggagatgggagtggcatttcaggggctcagggatcagggtagtttgagctggcggagtgggctagcactgggctggggagagtctctgcagcctcccatatcccctctcattcccagggagctaacatcctcatcaatgatgctggggaggtcagattggctgactttggcatctcggcccagattggggctacactggccagacgcctctctttcattgggacaccctactggatggctccggaagtggcagctgtggccctgaagggaggatacaatgagctgtgtgacatctggtccctgggcatcacggccatcgaactggccgagctacagccaccgctctttgatgtgcaccctctcagagttctcttcctcatgaccaagagtggctaccagcctccccgactgaaggaaaaaggcaaatggtcggctgccttccacaacttcatcaaagtcactctgactaagagtcccaagaaacgacccagcgccaccaagatgctcagtcatcaactggtatcccagcctgggctgaatcgaggcctgatcctggatcttcttgacaaactgaagaatcccgggaaaggaccctccattggggacattgaggatgaggagcccgagctaccccctgctatccctcggcggatcagatccacccaccgctccagctctctggggatcccagatgcagactgctgtcggcggcacatggagttcaggaagctccgaggaatggagaccagacccccagccaacaccgctcgcctacagcctcctcgagacctcaggagcagcagccccaggtcagggaccccagggaggatggggagggggctggaatgtggacaaggcccccaaggctcatacctgtcacccttcaggaagcaactgtcagagtcgtctgacgatgactatgacgacgtggacatccccacccctgcagaggacacacctcctccacttccccccaagcccaagttccgttctccatcagacgagggtcctgggagcatgggggatgatgggcagctgagcccgggggtgctggtccggtgtgccagtgggcccccaccaaacagcccccgtcctgggcctcccccatccaccagcagcccccacctcaccgcccattcagaaccctcactctggaacccaccctcccgggagcttgacaagcccccacttctgccccccaagaaggaaaagatgaagagaaagggatgtgcccttctcgtaaagttgttcaatggctgccccctccggatccacagcacggccgcctggacacatccctccaccaaggaccagcacctgctcctgggggcagaggaaggcatcttcatcctgaaccggaatgaccaggaggccacgctggaaatgctctttcctagccggactacgtgggtgtactccatcaacaacgttctcatgtctctctcaggaaagaccccccacctgtattctcatagcatccttggcctgctggaacggaaagagaccagagcaggaaaccccatcgctcacattagcccccaccgcctactggcaaggaagaacatggtttccaccaagatccaggacaccaaaggctgccgggcgtgctgtgtggcggagggtgcgagctctgggggcccgttcctgtgcggtgcattggagacgtccgttgtcctgcttcagtggtaccagcccatgaacaaattcctgcttgtccggcaggtgctgttcccactgccgacgcctctgtccgtgttcgcgctgctgaccgggccaggctctgagctgcccgctgtgtgcatcggcgtgagccccgggcggccggggaagtcggtgctcttccacacggtgcgctttggcgcgctctcttgctggctgggcgagatgagcaccgagcacaggggacccgtgcaggtgacccaggtagaggaagatatggtgatggtgttgatggatggctctgtgaagctggtgaccccggaggggtccccagtccggggacttcgcacacctgagatccccatgaccgaagcggtggaggccgtggctatggttggaggtcagcttcaggccttctggaagcatggagtgcaggtgtgggctctaggctcggatcagctgctacaggagctgagagaccctaccctcactttccgtctgcttggctcccccaggcctgtagtggtggagacacgcccagtggatgatcctactgctcccagcaacctctacatccaggaatgagtccctaggggggtgtcaggaactagtccttgcaccccctcccccatagacacactagtggtcatggcatgtcctcatctcccaataaacatgactttagcctctgc

SEQ ID NO: 334720 - DNA, 2835 bp, Homo sapiens
aaggcgggtgcagggcttctggggacggagggaggtgccagaagttgagccctgaggccctgctggcccctgggcgcaggcccagctcaggcccccagggatggacgtcgtggaccctgacattttcaatagagacccccgggaccactatgacctgctacagcggctgggtggcggcacgtatggggaagtctttaaggctcgagacaaggtgtcaggggacctggtggcactgaagatggtgaagatggagcctgatgatgatgtctccacccttcagaaggaaatcctcatattgaaaacttgccggcacgccaacatcgtggcctaccatgggagttatctctggttgcagaaactctggatctgcatggaattctgtggggctggttctctccaggacatctaccaagtgacaggctccctgtcagagctccagattagctatgtctgccgggaagtgctccagggactggcctatttgcactcacagaagaagatacacagggacatcaagggagctaacatcctcatcaatgatgctggggaggtcagattggctgactttggcatctcggcccagattggggctacactggccagacgcctctctttcattgggacaccctactggatggctccggaagtggcagctgtggccctgaagggaggatacaatgagctgtgtgacatctggtccctgggcatcacggccatcgaactggccgagctacagccaccgctctttgatgtgcaccctctcagagttctcttcctcatgaccaagagtggctaccagcctccccgactgaaggaaaaaggcaaatggtcggctgccttccacaacttcatcaaagtcactctgactaagagtcccaagaaacgacccagcgccaccaagatgctcagtcatcaactggtatcccagcctgggctgaatcgaggcctgatcctggatcttcttgacaaactgaagaatcccgggaaaggaccctccattggggacattgaggatgaggagcccgagctaccccctgctatccctcggcggatcagatccacccaccgctccagctctctggggatcccagatgcagactgctgtcggcggcacatggagttcaggaagctccgaggaatggagaccagacccccagccaacaccgctcgcctacagcctcctcgagacctcaggagcagcagccccaggtcagggaccccagggaggatggggagggggctggaatgtggacaaggcccccaaggctcatacctgtcacccttcaggaagcaactgtcagagtcgtctgacgatgactatgacgacgtggacatccccacccctgcagaggacacacctcctccacttccccccaagcccaagttccgttctccatcagacgagggtcctgggagcatgggggatgatgggcagctgagcccgggggtgctggtccggtgtgccagtgggcccccaccaaacagcccccgtcctgggcctcccccatccaccagcagcccccacctcaccgcccattcagaaccctcactctggaacccaccctcccgggagcttgacaagcccccacttctgccccccaagaaggaaaagatgaagagaaagggatgtgcccttctcgtaaagttgttcaatggctgccccctccggatccacagcacggccgcctggacacatccctccaccaaggaccagcacctgctcctgggggcagaggaaggcatcttcatcctgaaccggaatgaccaggaggccacgctggaaatgctctttcctagccggactacgtgggtgtactccatcaacaacgttctcatgtctctctcaggaaagaccccccacctgtattctcatagcatccttggcctgctggaacggaaagagaccagagcaggaaaccccatcgctcacattagcccccaccgcctactggcaaggaagaacatggtttccaccaagatccaggacaccaaaggctgccgggcgtgctgtgtggcggagggtgcgagctctgggggcccgttcctgtgcggtgcattggagacgtccgttgtcctgcttcagtggtaccagcccatgaacaaattcctgcttgtccggcaggtgctgttcccactgccgacgcctctgtccgtgttcgcgctgctgaccgggccaggctctgagctgcccgctgtgtgcatcggcgtgagccccgggcggccggggaagtcggtgctcttccacacggtgcgctttggcgcgctctcttgctggctgggcgagatgagcaccgagcacaggggacccgtgcaggtgacccaggtagaggaagatatggtgatggtgttgatggatggctctgtgaagctggtgaccccggaggggtccccagtccggggacttcgcacacctgagatccccatgaccgaagcggtggaggccgtgggtctgtgcagggacgggagagcccaggatcaggggtggaaactcaagtgatccccaagggtaacgggcattgctttctccccagctatggttggaggtcagcttcaggccttctggaagcatggagtgcaggtgtgggctctaggctcggatcagctgctacaggagctgagagaccctaccctcactttccgtctgcttggctcccccaggcctgtagtggtggagacacgcccagtggatgatcctactgctcccagcaacctctacatccaggaatgagtccctaggggggtgtcaggaactagtccttgcaccccctcccccatagacacactagtggtcatggcatgtcctcatctcccaataaacatgactttagcctctgc

SEQ ID NO: 334721 - DNA, 278 bp, Homo sapiens
tggaggtatcttccaggcactgagacacacactttttttccctagctgctacaggagctgagagaccctaccctcactttccgtctgcttggctcccccaggcctgtagtggtggagacacgcccagtggatgatcctactgctcccagcaacctctacatccaggaatgagtccctaggggggtgtcaggaactagtccttgcaccccctcccccatagacacactagtggtcatggcatgtcctcatctcccaataaacatgactttagcctctgc

SEQ ID NO: 334722 - DNA, 465 bp, Homo sapiens
ccccacccctgcagaggacacacctcctccacttccccccaaggtaaggccctgggccagagctgggaggctggggcctcagggccactgggggccaggaggccaggtccttagatgctgggatactgggctctccagggcagggaattggggagaccaggatgatggctacattgggatctggaagtggcatccctcaacctcagggtcggattcaaaatatttagcctcttagacactggtcagtagctggtcctaggaagcccctgctatatatccagcattaacccattagtttctgaagtgtgttgatgtccaggctggggatgtcaggggaaggctggagggggcacaagatgttgtcgggggggtgggtcagagccacagctgttagttctggtggaggcagggacttgagttgcaaaagggtgccctctctgagatcatctgatgtatttccccacg

SEQ ID NO: 334723 - DNA, 2751 bp, Homo sapiens
aaggcgggtgcagggcttctggggacggagggaggtgccagaagttgagccctgaggccctgctggcccctgggcgcaggcccagctcaggcccccagggatggacgtcgtggaccctgacattttcaatagagacccccgggaccactatgacctgctacagcggctgggtggcggcacgtatggggaagtctttaaggctcgagacaaggtgtcaggggacctggtggcactgaagatggtgaagatggagcctgatgatgatgtctccacccttcagaaggaaatcctcatattgaaaacttgccggcacgccaacatcgtggcctaccatgggagttatctctggttgcagaaactctggatctgcatggaattctgtggggctggttctctccaggacatctaccaagtgacaggctccctgtcagagctccagattagctatgtctgccgggaagtgctccagggactggcctatttgcactcacagaagaagatacacagggacatcaagggagctaacatcctcatcaatgatgctggggaggtcagattggctgactttggcatctcggcccagattggggctacactggccagacgcctctctttcattgggacaccctactggatggctccggaagtggcagctgtggccctgaagggaggatacaatgagctgtgtgacatctggtccctgggcatcacggccatcgaactggccgagctacagccaccgctctttgatgtgcaccctctcagagttctcttcctcatgaccaagagtggctaccagcctccccgactgaaggaaaaaggcaaatggtcggctgccttccacaacttcatcaaagtcactctgactaagagtcccaagaaacgacccagcgccaccaagatgctcagtcatcaactggtatcccagcctgggctgaatcgaggcctgatcctggatcttcttgacaaactgaagaatcccgggaaaggaccctccattggggacattgaggatgaggagcccgagctaccccctgctatccctcggcggatcagatccacccaccgctccagctctctggggatcccagatgcagactgctgtcggcggcacatggagttcaggaagctccgaggaatggagaccagacccccagccaacaccgctcgcctacagcctcctcgagacctcaggagcagcagccccaggtcagggaccccagggaggatggggagggggctggaatgtggacaaggcccccaaggctcatacctgtcacccttcaggaagcaactgtcagagtcgtctgacgatgactatgacgacgtggacatccccacccctgcagaggacacacctcctccacttccccccaagcccaagttccgttctccatcagacgagggtcctgggagcatgggggatgatgggcagctgagcccgggggtgctggtccggtgtgccagtgggcccccaccaaacagcccccgtcctgggcctcccccatccaccagcagcccccacctcaccgcccattcagaaccctcactctggaacccaccctcccgggagcttgacaagcccccacttctgccccccaagaaggaaaagatgaagagaaagggatgtgcccttctcgtaaagttgttcaatggctgccccctccggatccacagcacggccgcctggacacatccctccaccaaggaccagcacctgctcctgggggcagaggaaggcatcttcatcctgaaccggaatgaccaggaggccacgctggaaatgctctttcctagccggactacgtgggtgtactccatcaacaacgttctcatgtctctctcaggaaagaccccccacctgtattctcatagcatccttggcctgctggaacggaaagagaccagagcaggaaaccccatcgctcacattagcccccaccgcctactggcaaggaagaacatggtttccaccaagatccaggacaccaaaggctgccgggcgtgctgtgtggcggagggtgcgagctctgggggcccgttcctgtgcggtgcattggagacgtccgttgtcctgcttcagtggtaccagcccatgaacaaattcctgcttgtccggcaggtgctgttcccactgccgacgcctctgtccgtgttcgcgctgctgaccgggccaggctctgagctgcccgctgtgtgcatcggcgtgagccccgggcggccggggaagtcggtgctcttccacacggtgcgctttggcgcgctctcttgctggctgggcgagatgagcaccgagcacaggggacccgtgcaggtgacccaggtagaggaagatatggtgatggtgttgatggatggctctgtgaagctggtgaccccggaggggtccccagtccggggacttcgcacacctgagatccccatgaccgaagcggtggaggccgtggctatggttggaggtcagcttcaggccttctggaagcatggagtgcaggtgtgggctctaggctcggatcagctgctacaggagctgagagaccctaccctcactttccgtctgcttggctcccccaggcctgtagtggtggagacacgcccagtggatgatcctactgctcccagcaacctctacatccaggaatgagtccctaggggggtgtcaggaactagtccttgcaccccctcccccatagacacactagtggtcatggcatgtcctcatctcccaataaacatgactttagcctctgc

SEQ ID NO: 334724 - DNA, 2799 bp, Homo sapiens
aaggcgggtgcagggcttctggggacggagggaggtgccagaagttgagccctgaggccctgctggcccctgggcgcaggcccagctcaggcccccagggatggacgtcgtggaccctgacattttcaatagagacccccgggaccactatgacctgctacagcggctgggtggcggcacgtatggggaagtctttaaggctcgagacaaggtgtcaggggacctggtggcactgaagatggtgaagatggagcctgatgatgatgtctccacccttcagaaggaaatcctcatattgaaaacttgccggcacgccaacatcgtggcctaccatgggagttatctctggttgcagaaactctggatctgcatggaattctgtggggctggttctctccaggacatctaccaagtgacaggctccctgtcagagctccagattagctatgtctgccgggaagtgctccagggactggcctatttgcactcacagaagaagatacacagggacatcaagggagctaacatcctcatcaatgatgctggggaggtcagattggctgactttggcatctcggcccagattggggctacactggccagacgcctctctttcattgggacaccctactggatggctccggaagtggcagctgtggccctgaagggaggatacaatgagctgtgtgacatctggtccctgggcatcacggccatcgaactggccgagctacagccaccgctctttgatgtgcaccctctcagagttctcttcctcatgaccaagagtggctaccagcctccccgactgaaggaaaaaggcaaatggtcggctgccttccacaacttcatcaaagtcactctgactaagagtcccaagaaacgacccagcgccaccaagatgctcagtcatcaactggtatcccagcctgggctgaatcgaggcctgatcctggatcttcttgacaaactgaagaatcccgggaaaggaccctccattggggacattgaggatgaggagcccgagctaccccctgctatccctcggcggatcagatccacccaccgctccagctctctggggatcccagatgcagactgctgtcggcggcacatggagttcaggaagctccgaggaatggagaccagacccccagccaacaccgctcgcctacagcctcctcgagacctcaggagcagcagccccaggtcagggaccccagggaggatggggagggggctggaatgtggacaaggcccccaaggctcatacctgtcacccttcaggaagcaactgtcagagtcgtctgacgatgactatgacgacgtggacatccccacccctgcagaggacacacctcctccacttccccccaagcccaagttccgttctccatcagacgagggtcctgggagcatgggggatgatgggcagctgagcccgggggtgctggtccggtgtgccagtgggcccccaccaaacagcccccgtcctgggcctcccccatccaccagcagcccccacctcaccgcccattcagaaccctcactctggaacccaccctcccgggagcttgacaagcccccacttctgccccccaagaaggaaaagatgaagagaaagggatgtgcccttctcgtaaagttgttcaatggctgccccctccggatccacagcacggccgcctggacacatccctccaccaaggaccagcacctgctcctgggggcagaggaaggcatcttcatcctgaaccggaatgaccaggaggccacgctggaaatgctctttcctagccggactacgtgggtgtactccatcaacaacgttctcatgtctctctcaggaaagaccccccacctgtattctcatagcatccttggcctgctggaacggaaagagaccagagcaggaaaccccatcgctcacattagcccccaccgcctactggcaaggaagaacatggtttccaccaagatccaggacaccaaaggctgccgggcgtgctgtgtggcggagggtgcgagctctgggggcccgttcctgtgcggtgcattggagacgtccgttgtcctgcttcagtggtaccagcccatgaacaaattcctgcttgtccggcaggtgctgttcccactgccgacgcctctgtccgtgttcgcgctgctgaccgggccaggctctgagctgcccgctgtgtgcatcggcgtgagccccgggcggccggggaagtcggtgctcttccacacggtgcgctttggcgcgctctcttgctggctgggcgagatgagcaccgagcacaggggacccgtgcaggtgacccaggtagaggaagatatggtgatggtgttgatggatggctctgtgaagctggtgaccccggaggggtccccagtccggggacttcgcacacctgagatccccatgaccgaagcggtggaggccgtggctatggttggaggtcagcttcaggccttctggaagcatggagtgcaggtgtgggctctaggctcggatcagctgctacaggagctgagagaccctaccctcactttccgtctgcttggctcccccaggttcaagtgattctcatgcttcagcctcccaagtagctgggtttacaggcctgtagtggtggagacacgcccagtggatgatcctactgctcccagcaacctctacatccaggaatgagtccctaggggggtgtcaggaactagtccttgcaccccctcccccatagacacactagtggtcatggcatgtcctcatctcccaataaacatgactttagcctctgc

SEQ ID NO: 334725 - DNA, 401 bp, Homo sapiens
gtctttatttcagtcccggatccgcgggcgcaggcccagctcaggcccccagggatggacgtcgtggaccctgacattttcaatagagacccccgggaccactatgacctgctacagcggctgggtggcggcacgtatggggaagtctttaaggctcgagacaaggtgtcaggggacctggtggcactgaagatggtgaagatggagcctgatgatgatgtctccacccttcagaaggaaatcctcatattgaaaacttgccggcacgccaacatcgtggcctaccatgggagttatctctggttgcagaaactctggatctgcatggaattctgtggggctggttctctccaggacatctaccaaggttagagaaaggacaacgggacccaagcacccct

SEQ ID NO: 334726 - DNA, 338 bp, Homo sapiens
ttatgtaacgatttactaacagtaagggtgtatatattagataaaaattatattaattggatataagttctataaaatttatgaagcatcctgtcttttatttcacaagttttaaagtagatcatttatcaaagctgagtaaaattgaagtatacacctttttctttacacagagcccttgataagtatagaaattgaaaacagtattctagaaatgtaggaattcatataacccccaaaactcatgataacattgagataatcactttgtaagtgtatcttttttttctcttagcttaatatttttgagagtcttccatgttgtattatgtatcaag

SEQ ID NO: 334727 - DNA, 239 bp, Homo sapiens
tttctggaaggattaaactactagatgaaagttatctttagcgaatagggctgtggggaaggaatgagacaaggtgcaccttttatcataaccctctttgccctacatgacttttttactgtgtgcatcccgtagtccttcttattctctgtctcctccttttctcccaccatcactatcatcgtcattctctcagcaagccagtgcattttctgaagaactctagggacaaggtttta

SEQ ID NO: 334728 - DNA, 620 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaagatggagttcgctcttgttgcccaggctggaatgcaatggcatgaccttggctcactgcaacctctgcctccccagttcaagtggttctcctgcctcagcctcccgagtagctgagattacagaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctg

SEQ ID NO: 334729 - DNA, 626 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtggtgagtgatgagcctcacgttggctagagaagtggccgttagcgaggctacacactttgggatcgcgtggcctgagtcgggggagtaaccggcctgtattccatttttctctctccagtctcttcaaaatatcggagaataatttctttctcgctgatcgcctaacttctactgacgaagcttggaagttgcagaaggtagctcctaggagggatatatgggtcgttctttcctttttccttatttaaatgggtttttattgacaccatgtcgcgccaaaatggattccatctcctcagagctttcctaggaacagcctaacctcttgggcctaactttattttttttttgttctgcctttcatgtccagacttattagttttaattaatttgtttgtaacgtattcattatgcactagattaaacaatttttttctgtgcccactataccccaaatgtggagttttgggcaaaaacttaacatttg

SEQ ID NO: 334730 - DNA, 1056 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaaggttggagtgcagtggcgcgatctcggctgactgcaacctccacctcctggattcaagctattctcctgcctcagcctgccgagtagctgggattacaggcatgtgccaccgcacccagctaattttgtattttttagtagagatggggtttctccatgttggtcaggctggtcttgaactcctgacctcaggtgatccgcccacctcagcctcccaaagtgctgggattacaggcgtgagccaccgcgcccggccagaacattagttttaaacttcctaacccttgggagaaggcaaaacacttgatgaaatctacataaagactaaaacattttaccaattttgcattgtttgtttgaaattgcattgacgactggtatgttaattttgtatatatttttatgagaacaatgttggacatcatttaatttttttaggtttttttaattgattatggattggttcatttgcaggaactgactattagtaatcaaggatacaaattgttaagagaatatgttacagagaaaaacttgacaagctagacttagatttttgtcgttaaagataatttgtgggatatgatttttataaggagttgcattaaatagaatgtcttacacagatttaagaggttaataattataaaattaagatgagttcttataaaatattcttgaggtataataaaattatacttgtggagtatatctttgaataacatttaaaagcaaactaatactttccaggtaaaataattatcaacataactttttaaaaataattcatagtacttcaggttatttctatgtttgacacattaacttaaaagaaaaaa

SEQ ID NO: 334731 - DNA, 823 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaagatggagttcgctcttgttgcccaggctggaatgcaatggcatgaccttggctcactgcaacctctgcctccccagttcaagtggttctcctgcctcagcctcccgagtagctgagattacagaaaccacaataaaggctctcgcccacattcttccctcaccctctgcctcctgactgacactggtgctttcctgggtgaaccctgacggtgtggcatgcctcttcttgtgatctattgttcactgttggcatatagaaacactactgatgcctcagagatgaccatgatggtgttctggtgtcaggagaatagcaatgcctgggagtccaccaccaccataatctcctgtgatcccacggagctgcagtcagaagggagcaatgacaagaaataagtgctgagcagttgtcatatggtgctggaagacatgctacttttccctgagggcggaagacagcctgatgacggtggtacaatcaatgacatctctgtgctgggagtgacctgcttgggggcccaggctgatcatttcacacagacacccctggatcctggaagccaagtcctggtctgggtagactgggagtggaggtttgaccacat

SEQ ID NO: 334732 - DNA, 1047 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaagatggagttcgctcttgttgcccaggctggaatgcaatggcatgaccttggctcactgcaacctctgcctccccagttcaagtggttctcctgcctcagcctcccgagtagctgagattacaggtactggctcctgtatcacccagctctggagttgaaagagctcttcattcctgagtctcctgtaccactgagaatagtccagcctgggtaacagagcaagactctgtttcaaaaaaaaaaaaaaaaaagggaagagtcaccacaacttctagtgttagggccagttacaccaaaaatttacaaaaatgtggcttggcgaaatttttgacagcgcacctaatcaggggggagacataaccctggctcagggcttcaacaagagtggctcatggtaaacaacaagagtcagacgcatccgtaaactgtggactcccccaagatctcccaatggcaaattctctacgtataatagatcacacgaggggcacttctgggccacgacacttatccaggctgggatactaccatttataattcgaaacgggtcacgagcttgcacaaataatacaaactaggcaactcatatcctacaacaagcaactaaggggcgcaaaaggagacttacaattaaccaaaattcacccaagaaaatcaccctaaacaaacgattgacacagtcaaccgatactagtgacggtctgggtcacaaagacaatacaagaaaacacgcgagcagacaataacagagcagagcagcagcgaacagagagtcagaaacagcacaaagcgcacaaacagtactacggccaccgctgtgttccacgggg

SEQ ID NO: 334733 - DNA, 998 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaagatggagttcgctcttgttgcccaggctggaatgcaatggcatgaccttggctcactgcaacctctgcctccccagttcaagtggttctcctgcctcagcctcccgagtagctgagattacaggtatgcgctaccacgcccggctaattttgtatttttagtagagacggggtttctccatgttggtcagactggtcttgtaggagaaatagacttcactaaaatattacagccaattagtaaaaataagacagtaaatagtaacaccttgtcctggagtgatagtagccagtattgctaccatatattactgacaatgtttaattttcaacaacaaaaataattgagagataaagagaagtaagaaaacgtgaccttatggggaagaagactggcaaaacatctcaactttgaaggcataagatgtgttactaagcagacaaatatttcaaattggccattataaatatcttaaaagaactagaggacaccatacctcaggaggcaatgatataattacaataattttgcaactagagaatataaataaataggtaagaattatagaaaagaaccatatggaaatctggagttgtaaagtataataacagaaattacaattcattagagaggtttaatactagattttaactggtagaataaacaatcattgaatttgaagatagattgatagaaatcacccagtttaaaaaatacagaataaagaagtaagtaaaatgcagtttcagagaaatggcagaagccattgagaataccaaca

SEQ ID NO: 334734 - DNA, 921 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaaggttggagtgcagtggcgcgatctcggctgactgcaacctccacctcctggattcaagctattctcctgcctcagcctgccgagtagctgggattacaggcgtgagccaccgcgcccggccagaacattagttttaaacttcctaacccttgggagaaggcaaaacacttgatgaaatctacataaagactaaaacattttaccaattttgcattgtttgtttgaaattgcattgacgactggtatgttaattttgtatatatttttatgagaacaatgttggacatcatttaatttttttaggtttttttaattgattatggattggttcatttgcaggaactgactattagtaatcaaggatacaaattgttaagagaatatgttacagagaaaaacttgacaagctagacttagatttttgtcgttaaagataatttgtgggatatgatttttataaggagttgcattaaatagaatgtcttacacagatttaagaggttaataattataaaattaagatgagttcttataaaatattcttgaggtataataaaattatacttgtggagtatatctttgaataacatttaaaagcaaactaatactttccaggtaaaataattatcaacataactttttaaaaataattcatagtacttcaggttatttctatgtttgacacattaacttaaaagaaaaaa

SEQ ID NO: 334735 - DNA, 455 bp, Homo sapiens
cttggcctgctctggtgatgaattcgtttctgcagactttccctgggagtaatttgtacacatactgactgccccatattttacatccctcattcaaggtactggctcctgtatcacccagctctggagttgaaagagctcttcattcctgagtctcctgtaccactgagaatagaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctg

SEQ ID NO: 334736 - DNA, 575 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaaggtactggctcctgtatcacccagctctggagttgaaagagctcttcattcctgagtctcctgtaccactgagaatagaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctg

SEQ ID NO: 334737 - DNA, 498 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaagaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctg

SEQ ID NO: 334738 - DNA, 373 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaaggttggagtgcagtggcgcgatctcggctgactgcaacctccacctcctggattcaaggagaatcacttgaacctgggaggcagaggttgcagtgagccaagattgtgccactgcacttcccagcctgagcaacaaaagcaaaactctatctttaa

SEQ ID NO: 334739 - DNA, 592 bp, Homo sapiens
atagaggtccttagggctttttctcacttctcttttctctacatatttgtgtaaaaataagacagtaaatagtaacaccttgtcctggagtgatagtagccagtattgctaccatatattactgacaatgtttaattttcaacaacaaaaataattgagagataaagagaagtaagaaaacgtgaccttatggggaagaagactggcaaaacatctcaactttgaaggcataagatgtgttactaagcagacaaatatttcaaattggccattataaatatcttaaaagaactagaggacaccatacctcaggaggcaatgatataattacaataattttgcaactagagaatataaataaataggtaagaattatagaaaagaaccatatggaaatctggagttgtaaagtataataacagaaattacaattcattagagaggtttaatactagattttaactggtagaataaacaatcattgaatttgaagatagattgatagaaatcacccagtttaaaaaatacagaataaagaagtaagtaaaatgcagtttcagagaaatggcagaagccattgagaataccaaca

SEQ ID NO: 334740 - DNA, 3465 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaaggttggagtgcagtggcgcgatctcggctgactgcaacctccacctcctggattcaagctattctcctgcctcagcctgccgagtagctgggattacaggcatgtgccaccgcacccagctaattttgtattttttagtagagatggggtttctccatgttggtcaggctggtcttgaactcctgacctcaggtgatccgcccacctcagcctcccaaagtgctgggattacaggcgtgagccaccgcgcccggccagaacattagttttaaacttcctaacccttgggagaaggcaaaacacttgatgaaatctacataaagactaaaacattttaccaattttgcattgtttgtttgaaattgcattgacgactgatggagttcgctcttgttgcccaggctggaatgcaatggcatgaccttggctcactgcaacctctgcctccccagttcaagtggttctcctgcctcagcctcccgagtagctgagattacaggtactggctcctgtatcacccagctctggagttgaaagagctcttcattcctgagtctcctgtaccactgagaataggctggagtgcagtggcgcaatctcggctctctgcaaccttcacctcccgtgttcaagtgattctcctgcctcagcctcctgaatacctgagattacaagcatgcaccaccacgcccgtctaattttgtattttcactagagacggggtttctccatgttggtcaggctggtctcgaactcccgacctcaggtgatccgcccgcctcagcctcccaaagtgctgggattacaggcatgagccaccgcgtccagcaagaataggtgattttcaaacttggaaacattcagaagttatcgcctcagtttcagattgagtagtctcaaagagattacagacatctaccacaaattctctacttggtgtggtgcaaaatcagtatgatgtaaactttgtctctcagtttcttcaaaggaaagaagcaactggaacacacatataacactaacccttccagctgcattatgagggaccagtacctgtctcaaggcaaaattatgacttagttcatcctcacctctggaggccagtaaaagtgggttatagaagaacaaagaggcatctagatctttcactgggttatttggagagaaacatctcctaccgaaggccagtttaacaagactggtagaggaggttatcttatctaattcacagaaatcaacacattgagtcaagaaaaatgaaacacagaaacactctaaataaaagaagataagtcttcagaaaccaaccctaatgaaatgaagatatgtgattaacctgacaggaaattaaaaagagcaaccataaagagtctcatgggagcaatgcatgaacaaactgagaattttcataaagaaataaaagataacaaaaagtataaagttgaagaatacaataactggactcaaaaatttaatgtgtccaacagaagaatcgatgaagcagaagaaagggctatcaaacttgtagataggccattggaaatcatgtaatgtgaggagaaaaaagaaaaaagattgaagatagtttaagagacttttgagacatcctcaaaggggaataatttatacattaccagatggagaagatagagggaaaaggacagaaaacatatttgaagaaataatgtcagaaaacctcataattctggcaaggaaatagaaatttagatctaagaatctcgaacatcaggtatgatgaatccaaggagactcacaccaaaccatattgtaattaaataaaggttaaagacaatcttcagagcagcaagggaatagtctcttcttacatacaaaatgatccacggaagactgtcagcagacttcaccagaaaactttcacgccagaaggcagtcgtgatatatacaaaaagctgaaaggaaaacactgccatccaggaatactatctccaactatcctgtgtttcaaaaattaaggagaaatataaagttctcaaacaaaagatgtgggagtttaccaccactagacctgcacgggaagaattgctaaagggagtccttcaagctgtagtaaaagagtgctaattagaaacatgaaaacaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctgtatatctatatgtgaaattgaaccattttctcatagcatatagaaaaatcaactcaaaatggattaaagcctgaaatgttgcctttgaaactgtaaaactactagtagaaaatataggggaaaagctctatgatgttgttctgggcaatgatttcttggatacatccttaaaagcatgggcagcaaaaacagccagacaactatcagggaacctgcccagatagtcacataggttcttttctattttccctaagcattggccgggttgagaaataaagggacagagtacaaaagagagaaattttaaagctgggcatcctggggagacatcacatgtcggtaggttccgtgatgccccctgagccgtaaaaccagtaagtttttattagggattttcaaaggggagggagtatacgaataggaggtgggtcacagagatcacgtgcttcacaaggtaatagaatatcacaaggcaaatggaggcagggcgagatcacaggaccacaggactgggttgaaattaaaattgctaatgaagtttcgggcaccatcgtcattgataacatcttatcaggagacagggtttgagagcaacctgtctgaccaaaatttattaggtgggaatttcctcgtcctaataagcctgggagcgctatgggagactggggcttatttcatccctacagtctcgaccatagaagacagctacacccaagggggccattttagaggcccaccctcaggggcacattctctttctcagggatgttccttgctgagaaaaagaattcggcgatatttctcccatttgcttttgaaagaagagaaatatggctctgttccgcctgg

SEQ ID NO: 334741 - DNA, 3089 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaagatggagttcgctcttgttgcccaggctggaatgcaatggcatgaccttggctcactgcaacctctgcctccccagttcaagtggttctcctgcctcagcctcccgagtagctgagattacaggtactggctcctgtatcacccagctctggagttgaaagagctcttcattcctgagtctcctgtaccactgagaataggctggagtgcagtggcgcaatctcggctctctgcaaccttcacctcccgtgttcaagtgattctcctgcctcagcctcctgaatacctgagattacaagcatgcaccaccacgcccgtctaattttgtattttcactagagacggggtttctccatgttggtcaggctggtctcgaactcccgacctcaggtgatccgcccgcctcagcctcccaaagtgctgggattacaggcatgagccaccgcgtccagcaagaataggtgattttcaaacttggaaacattcagaagttatcgcctcagtttcagattgagtagtctcaaagagattacagacatctaccacaaattctctacttggtgtggtgcaaaatcagtatgatgtaaactttgtctctcagtttcttcaaaggaaagaagcaactggaacacacatataacactaacccttccagctgcattatgagggaccagtacctgtctcaaggcaaaattatgacttagttcatcctcacctctggaggccagtaaaagtgggttatagaagaacaaagaggcatctagatctttcactgggttatttggagagaaacatctcctaccgaaggccagtttaacaagactggtagaggaggttatcttatctaattcacagaaatcaacacattgagtcaagaaaaatgaaacacagaaacactctaaataaaagaagataagtcttcagaaaccaaccctaatgaaatgaagatatgtgattaacctgacaggaaattaaaaagagcaaccataaagagtctcatgggagcaatgcatgaacaaactgagaattttcataaagaaataaaagataacaaaaagtataaagttgaagaatacaataactggactcaaaaatttaatgtgtccaacagaagaatcgatgaagcagaagaaagggctatcaaacttgtagataggccattggaaatcatgtaatgtgaggagaaaaaagaaaaaagattgaagatagtttaagagacttttgagacatcctcaaaggggaataatttatacattaccagatggagaagatagagggaaaaggacagaaaacatatttgaagaaataatgtcagaaaacctcataattctggcaaggaaatagaaatttagatctaagaatctcgaacatcaggtatgatgaatccaaggagactcacaccaaaccatattgtaattaaataaaggttaaagacaatcttcagagcagcaagggaatagtctcttcttacatacaaaatgatccacggaagactgtcagcagacttcaccagaaaactttcacgccagaaggcagtcgtgatatatacaaaaagctgaaaggaaaacactgccatccaggaatactatctccaactatcctgtgtttcaaaaattaaggagaaatataaagttctcaaacaaaagatgtgggagtttaccaccactagacctgcacgggaagaattgctaaagggagtccttcaagctgtagtaaaagagtgctaattagaaacatgaaaacaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctgtatatctatatgtgaaattgaaccattttctcatagcatatagaaaaatcaactcaaaatggattaaagcctgaaatgttgcctttgaaactgtaaaactactagtagaaaatataggggaaaagctctatgatgttgttctgggcaatgatttcttggatacatccttaaaagcatgggcagcaaaaacagccagacaactatcagggaacctgcccagatagtcacataggttcttttctattttccctaagcattggccgggttgagaaataaagggacagagtacaaaagagagaaattttaaagctgggcatcctggggagacatcacatgtcggtaggttccgtgatgccccctgagccgtaaaaccagtaagtttttattagggattttcaaaggggagggagtatacgaataggaggtgggtcacagagatcacgtgcttcacaaggtaatagaatatcacaaggcaaatggaggcagggcgagatcacaggaccacaggactgggttgaaattaaaattgctaatgaagtttcgggcaccatcgtcattgataacatcttatcaggagacagggtttgagagcaacctgtctgaccaaaatttattaggtgggaatttcctcgtcctaataagcctgggagcgctatgggagactggggcttatttcatccctacagtctcgaccatagaagacagctacacccaagggggccattttagaggcccaccctcaggggcacattctctttctcagggatgttccttgctgagaaaaagaattcggcgatatttctcccatttgcttttgaaagaagagaaatatggctctgttccgcctgg

SEQ ID NO: 334742 - DNA, 2616 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaaggttggagtgcagtggcgcgatctcggctgactgcaacctccacctcctggattcaagctattctcctgcctcagcctgccgagtagctgggattacaggcatgtgccaccgcacccagctaattttgtattttttagtagagatggggtttctccatgttggtcaggctggtcttgaactcctgacctcaggtgatccgcccacctcagcctcccaaagtgctgggattacaggcgtgagccaccgcgcccggccagaacattagttttaaacttcctaacccttgggagaaggcaaaacacttgatgaaatctacataaagactaaaacattttaccaattttgcattgtttgtttgaaattgcattgacgactgatggagttcgctcttgttgcccaggctggaatgcaatggcatgaccttggctcactgcaacctctgcctccccagttcaagtggttctcctgcctcagcctcccgagtagctgagattacaggtactggctcctgtatcacccagctctggagttgaaagagctcttcattcctgagtctcctgtaccactgagaataggctggagtgcagtggcgcaatctcggctctctgcaaccttcacctcccgtgttcaagtgattctcctgcctcagcctcctgaatacctgagattacaagcatgcaccaccacgcccgtctaattttgtattttcactagagacggggtttctccatgttggtcaggctggtctcgaactcccgacctcaggtgatccgcccgcctcagcctcccaaagtgctgggattacaggcatgagccaccgcgtccagcaagaataggtgattttcaaacttggaaacattcagaagttatcgcctcagtttcagattgagtagtctcaaagagattacagacatctaccacaaattctctacttggtgtggtgcaaaatcagtatgatgtaaactttgtctctcagtttcttcaaaggaaagaagcaactggaacacacatataacactaacccttccagctgcattatgagggaccagtacctgtctcaaggcaaaattatgacttagttcatcctcacctctggaggccagtaaaagtgggttatagaagaacaaagaggcatctagatctttcactgggttatttggagagaaacatctcctaccgaaggccagtttaacaagactggtagaggaggttatcttatctaattcacagaaatcaacacattgagtcaagaaaaatgaaacacagaaacactctaaataaaagaagataagtcttcagaaaccaaccctaatgaaatgaagatatgtgattaacctgacaggaaattaaaaagagcaaccataaagagtctcatgggagcaatgcatgaacaaactgagaattttcataaagaaataaaagataacaaaaagtataaagttgaagaatacaataactggactcaaaaatttaatgtgtccaacagaagaatcgatgaagcagaagaaagggctatcaaacttgtagataggccattggaaatcatgtaatgtgaggagaaaaaagaaaaaagattgaagatagtttaagagacttttgagacatcctcaaaggggaataatttatacattaccagatggagaagatagagggaaaaggacagaaaacatatttgaagaaataatgtcagaaaacctcataattctggcaaggaaatagaaatttagatctaagaatctcgaacatcaggtatgatgaatccaaggagactcacaccaaaccatattgtaattaaataaaggttaaagacaatcttcagagcagcaagggaatagtctcttcttacatacaaaatgatccacggaagactgtcagcagacttcaccagaaaactttcacgccagaaggcagtcgtgatatatacaaaaagctgaaaggaaaacactgccatccaggaatactatctccaactatcctgtgtttcaaaaattaaggagaaatataaagttctcaaacaaaagatgtgggagtttaccaccactagacctgcacgggaagaattgctaaagggagtccttcaagctgtagtaaaagagtgctaattagaaacatgaaaacaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctg

SEQ ID NO: 334743 - DNA, 3498 bp, Homo sapiens
tatgaacttcagttgccttggaggcatctgagggaaatgaggttgcatgtagatgaatcagttgtttctggcatcatgttagtgtgattacatttagctgctgtgtgcaaaacattttagcaatcatttaggtccaggacgtggaatttattagtgcaacaaccctgtaaacagtggttagaacattaataattttattttatttatgttttatttattttttgagacggatttttgctcttgttgcccaggttggagtgcagtggcgcgatctcggctgactgcaacctccacctcctggattcaagctattctcctgcctcagcctgccgagtagctgggattacaggcatgtgccaccgcacccagctaattttgtattttttagtagagatggggtttctccatgttggtcaggctggtcttgaactcctgacctcaggtgatccgcccacctcagcctcccaaagtgctgggattacaggcgtgagccaccgcgcccggccagaacattagttttaaacttcctaacccttgggagaaggcaaaacacttgatgaaatctacataaagactaaaacattttaccaattttgcattgtttgtttgaaattgcattgacgactgatggagttcgctcttgttgcccaggctggaatgcaatggcatgaccttggctcactgcaacctctgcctccccagttcaagtggttctcctgcctcagcctcccgagtagctgagattacaggtactggctcctgtatcacccagctctggagttgaaagagctcttcattcctgagtctcctgtaccactgagaataggctggagtgcagtggcgcaatctcggctctctgcaaccttcacctcccgtgttcaagtgattctcctgcctcagcctcctgaatacctgagattacaagcatgcaccaccacgcccgtctaattttgtattttcactagagacggggtttctccatgttggtcaggctggtctcgaactcccgacctcaggtgatccgcccgcctcagcctcccaaagtgctgggattacaggcatgagccaccgcgtccagcaagaataggtgattttcaaacttggaaacattcagaagttatcgcctcagtttcagattgagtagtctcaaagagattacagacatctaccacaaattctctacttggtgtggtgcaaaatcagtatgatgtaaactttgtctctcagtttcttcaaaggaaagaagcaactggaacacacatataacactaacccttccagctgcattatgagggaccagtacctgtctcaaggcaaaattatgacttagttcatcctcacctctggaggccagtaaaagtgggttatagaagaacaaagaggcatctagatctttcactgggttatttggagagaaacatctcctaccgaaggccagtttaacaagactggtagaggaggttatcttatctaattcacagaaatcaacacattgagtcaagaaaaatgaaacacagaaacactctaaataaaagaagataagtcttcagaaaccaaccctaatgaaatgaagatatgtgattaacctgacaggaaattaaaaagagcaaccataaagagtctcatgggagcaatgcatgaacaaactgagaattttcataaagaaataaaagataacaaaaagtataaagttgaagaatacaataactggactcaaaaatttaatgtgtccaacagaagaatcgatgaagcagaagaaagggctatcaaacttgtagataggccattggaaatcatgtaatgtgaggagaaaaaagaaaaaagattgaagatagtttaagagacttttgagacatcctcaaaggggaataatttatacattaccagatggagaagatagagggaaaaggacagaaaacatatttgaagaaataatgtcagaaaacctcataattctggcaaggaaatagaaatttagatctaagaatctcgaacatcaggtatgatgaatccaaggagactcacaccaaaccatattgtaattaaataaaggttaaagacaatcttcagagcagcaagggaatagtctcttcttacatacaaaatgatccacggaagactgtcagcagacttcaccagaaaactttcacgccagaaggcagtcgtgatatatacaaaaagctgaaaggaaaacactgccatccaggaatactatctccaactatcctgtgtttcaaaaattaaggagaaatataaagttctcaaacaaaagatgtgggagtttaccaccactagacctgcacgggaagaattgctaaagggagtccttcaagctgtagtaaaagagtgctaattagaaacatgaaaacaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctgtatatctatatgtgaaattgaaccattttctcatagcatatagaaaaatcaactcaaaatggattaaagcctgaaatgttgcctttgaaactgtaaaactactagtagaaaatataggggaaaagctctatgatgttgttctgggcaatgatttcttggatacatccttaaaagcatgggcagcaaaaacagccagacaactatcagggaacctgcccagatagtcacataggttcttttctattttccctaagcattggccgggttgagaaataaagggacagagtacaaaagagagaaattttaaagctgggcatcctggggagacatcacatgtcggtaggttccgtgatgccccctgagccgtaaaaccagtaagtttttattagggattttcaaaggggagggagtatacgaataggaggtgggtcacagagatcacgtgcttcacaaggtaatagaatatcacaaggcaaatggaggcagggcgagatcacaggaccacaggactgggttgaaattaaaattgctaatgaagtttcgggcaccatcgtcattgataacatcttatcaggagacagggtttgagagcaacctgtctgaccaaaatttattaggtgggaatttcctcgtcctaataagcctgggagcgctatgggagactggggcttatttcatccctacagtctcgaccatagaagacagctacacccaagggggccattttagaggcccaccctcaggggcacattctctttctcagggatgttccttgctgagaaaaagaattcggcgatatttctcccatttgcttttgaaagaagagaaatatggctctgttccgcctgg

SEQ ID NO: 334744 - DNA, 2967 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaaggtactggctcctgtatcacccagctctggagttgaaagagctcttcattcctgagtctcctgtaccactgagaataggctggagtgcagtggcgcaatctcggctctctgcaaccttcacctcccgtgttcaagtgattctcctgcctcagcctcctgaatacctgagattacaagcatgcaccaccacgcccgtctaattttgtattttcactagagacggggtttctccatgttggtcaggctggtctcgaactcccgacctcaggtgatccgcccgcctcagcctcccaaagtgctgggattacaggcatgagccaccgcgtccagcaagaataggtgattttcaaacttggaaacattcagaagttatcgcctcagtttcagattgagtagtctcaaagagattacagacatctaccacaaattctctacttggtgtggtgcaaaatcagtatgatgtaaactttgtctctcagtttcttcaaaggaaagaagcaactggaacacacatataacactaacccttccagctgcattatgagggaccagtacctgtctcaaggcaaaattatgacttagttcatcctcacctctggaggccagtaaaagtgggttatagaagaacaaagaggcatctagatctttcactgggttatttggagagaaacatctcctaccgaaggccagtttaacaagactggtagaggaggttatcttatctaattcacagaaatcaacacattgagtcaagaaaaatgaaacacagaaacactctaaataaaagaagataagtcttcagaaaccaaccctaatgaaatgaagatatgtgattaacctgacaggaaattaaaaagagcaaccataaagagtctcatgggagcaatgcatgaacaaactgagaattttcataaagaaataaaagataacaaaaagtataaagttgaagaatacaataactggactcaaaaatttaatgtgtccaacagaagaatcgatgaagcagaagaaagggctatcaaacttgtagataggccattggaaatcatgtaatgtgaggagaaaaaagaaaaaagattgaagatagtttaagagacttttgagacatcctcaaaggggaataatttatacattaccagatggagaagatagagggaaaaggacagaaaacatatttgaagaaataatgtcagaaaacctcataattctggcaaggaaatagaaatttagatctaagaatctcgaacatcaggtatgatgaatccaaggagactcacaccaaaccatattgtaattaaataaaggttaaagacaatcttcagagcagcaagggaatagtctcttcttacatacaaaatgatccacggaagactgtcagcagacttcaccagaaaactttcacgccagaaggcagtcgtgatatatacaaaaagctgaaaggaaaacactgccatccaggaatactatctccaactatcctgtgtttcaaaaattaaggagaaatataaagttctcaaacaaaagatgtgggagtttaccaccactagacctgcacgggaagaattgctaaagggagtccttcaagctgtagtaaaagagtgctaattagaaacatgaaaacaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctgtatatctatatgtgaaattgaaccattttctcatagcatatagaaaaatcaactcaaaatggattaaagcctgaaatgttgcctttgaaactgtaaaactactagtagaaaatataggggaaaagctctatgatgttgttctgggcaatgatttcttggatacatccttaaaagcatgggcagcaaaaacagccagacaactatcagggaacctgcccagatagtcacataggttcttttctattttccctaagcattggccgggttgagaaataaagggacagagtacaaaagagagaaattttaaagctgggcatcctggggagacatcacatgtcggtaggttccgtgatgccccctgagccgtaaaaccagtaagtttttattagggattttcaaaggggagggagtatacgaataggaggtgggtcacagagatcacgtgcttcacaaggtaatagaatatcacaaggcaaatggaggcagggcgagatcacaggaccacaggactgggttgaaattaaaattgctaatgaagtttcgggcaccatcgtcattgataacatcttatcaggagacagggtttgagagcaacctgtctgaccaaaatttattaggtgggaatttcctcgtcctaataagcctgggagcgctatgggagactggggcttatttcatccctacagtctcgaccatagaagacagctacacccaagggggccattttagaggcccaccctcaggggcacattctctttctcagggatgttccttgctgagaaaaagaattcggcgatatttctcccatttgcttttgaaagaagagaaatatggctctgttccgcctgg

SEQ ID NO: 334745 - DNA, 3010 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgatggagttcgctcttgttgcccaggctggaatgcaatggcatgaccttggctcactgcaacctctgcctccccagttcaagtggttctcctgcctcagcctcccgagtagctgagattacaggtactggctcctgtatcacccagctctggagttgaaagagctcttcattcctgagtctcctgtaccactgagaataggctggagtgcagtggcgcaatctcggctctctgcaaccttcacctcccgtgttcaagtgattctcctgcctcagcctcctgaatacctgagattacaagcatgcaccaccacgcccgtctaattttgtattttcactagagacggggtttctccatgttggtcaggctggtctcgaactcccgacctcaggtgatccgcccgcctcagcctcccaaagtgctgggattacaggcatgagccaccgcgtccagcaagaataggtgattttcaaacttggaaacattcagaagttatcgcctcagtttcagattgagtagtctcaaagagattacagacatctaccacaaattctctacttggtgtggtgcaaaatcagtatgatgtaaactttgtctctcagtttcttcaaaggaaagaagcaactggaacacacatataacactaacccttccagctgcattatgagggaccagtacctgtctcaaggcaaaattatgacttagttcatcctcacctctggaggccagtaaaagtgggttatagaagaacaaagaggcatctagatctttcactgggttatttggagagaaacatctcctaccgaaggccagtttaacaagactggtagaggaggttatcttatctaattcacagaaatcaacacattgagtcaagaaaaatgaaacacagaaacactctaaataaaagaagataagtcttcagaaaccaaccctaatgaaatgaagatatgtgattaacctgacaggaaattaaaaagagcaaccataaagagtctcatgggagcaatgcatgaacaaactgagaattttcataaagaaataaaagataacaaaaagtataaagttgaagaatacaataactggactcaaaaatttaatgtgtccaacagaagaatcgatgaagcagaagaaagggctatcaaacttgtagataggccattggaaatcatgtaatgtgaggagaaaaaagaaaaaagattgaagatagtttaagagacttttgagacatcctcaaaggggaataatttatacattaccagatggagaagatagagggaaaaggacagaaaacatatttgaagaaataatgtcagaaaacctcataattctggcaaggaaatagaaatttagatctaagaatctcgaacatcaggtatgatgaatccaaggagactcacaccaaaccatattgtaattaaataaaggttaaagacaatcttcagagcagcaagggaatagtctcttcttacatacaaaatgatccacggaagactgtcagcagacttcaccagaaaactttcacgccagaaggcagtcgtgatatatacaaaaagctgaaaggaaaacactgccatccaggaatactatctccaactatcctgtgtttcaaaaattaaggagaaatataaagttctcaaacaaaagatgtgggagtttaccaccactagacctgcacgggaagaattgctaaagggagtccttcaagctgtagtaaaagagtgctaattagaaacatgaaaacaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctgtatatctatatgtgaaattgaaccattttctcatagcatatagaaaaatcaactcaaaatggattaaagcctgaaatgttgcctttgaaactgtaaaactactagtagaaaatataggggaaaagctctatgatgttgttctgggcaatgatttcttggatacatccttaaaagcatgggcagcaaaaacagccagacaactatcagggaacctgcccagatagtcacataggttcttttctattttccctaagcattggccgggttgagaaataaagggacagagtacaaaagagagaaattttaaagctgggcatcctggggagacatcacatgtcggtaggttccgtgatgccccctgagccgtaaaaccagtaagtttttattagggattttcaaaggggagggagtatacgaataggaggtgggtcacagagatcacgtgcttcacaaggtaatagaatatcacaaggcaaatggaggcagggcgagatcacaggaccacaggactgggttgaaattaaaattgctaatgaagtttcgggcaccatcgtcattgataacatcttatcaggagacagggtttgagagcaacctgtctgaccaaaatttattaggtgggaatttcctcgtcctaataagcctgggagcgctatgggagactggggcttatttcatccctacagtctcgaccatagaagacagctacacccaagggggccattttagaggcccaccctcaggggcacattctctttctcagggatgttccttgctgagaaaaagaattcggcgatatttctcccatttgcttttgaaagaagagaaatatggctctgttccgcctgg

SEQ ID NO: 334746 - DNA, 2611 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaagatggagttcgctcttgttgcccaggctggaatgcaatggcatgaccttggctcactgcaacctctgcctccccagttcaagtggttctcctgcctcagcctcccgagtagctgagattacagtttcttcaaaggaaagaagcaactggaacacacatataacactaacccttccagctgcattatgagggaccagtacctgtctcaaggcaaaattatgacttagttcatcctcacctctggaggccagtaaaagtgggttatagaagaacaaagaggcatctagatctttcactgggttatttggagagaaacatctcctaccgaaggccagtttaacaagactggtagaggaggttatcttatctaattcacagaaatcaacacattgagtcaagaaaaatgaaacacagaaacactctaaataaaagaagataagtcttcagaaaccaaccctaatgaaatgaagatatgtgattaacctgacaggaaattaaaaagagcaaccataaagagtctcatgggagcaatgcatgaacaaactgagaattttcataaagaaataaaagataacaaaaagtataaagttgaagaatacaataactggactcaaaaatttaatgtgtccaacagaagaatcgatgaagcagaagaaagggctatcaaacttgtagataggccattggaaatcatgtaatgtgaggagaaaaaagaaaaaagattgaagatagtttaagagacttttgagacatcctcaaaggggaataatttatacattaccagatggagaagatagagggaaaaggacagaaaacatatttgaagaaataatgtcagaaaacctcataattctggcaaggaaatagaaatttagatctaagaatctcgaacatcaggtatgatgaatccaaggagactcacaccaaaccatattgtaattaaataaaggttaaagacaatcttcagagcagcaagggaatagtctcttcttacatacaaaatgatccacggaagactgtcagcagacttcaccagaaaactttcacgccagaaggcagtcgtgatatatacaaaaagctgaaaggaaaacactgccatccaggaatactatctccaactatcctgtgtttcaaaaattaaggagaaatataaagttctcaaacaaaagatgtgggagtttaccaccactagacctgcacgggaagaattgctaaagggagtccttcaagctgtagtaaaagagtgctaattagaaacatgaaaacaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctgtatatctatatgtgaaattgaaccattttctcatagcatatagaaaaatcaactcaaaatggattaaagcctgaaatgttgcctttgaaactgtaaaactactagtagaaaatataggggaaaagctctatgatgttgttctgggcaatgatttcttggatacatccttaaaagcatgggcagcaaaaacagccagacaactatcagggaacctgcccagatagtcacataggttcttttctattttccctaagcattggccgggttgagaaataaagggacagagtacaaaagagagaaattttaaagctgggcatcctggggagacatcacatgtcggtaggttccgtgatgccccctgagccgtaaaaccagtaagtttttattagggattttcaaaggggagggagtatacgaataggaggtgggtcacagagatcacgtgcttcacaaggtaatagaatatcacaaggcaaatggaggcagggcgagatcacaggaccacaggactgggttgaaattaaaattgctaatgaagtttcgggcaccatcgtcattgataacatcttatcaggagacagggtttgagagcaacctgtctgaccaaaatttattaggtgggaatttcctcgtcctaataagcctgggagcgctatgggagactggggcttatttcatccctacagtctcgaccatagaagacagctacacccaagggggccattttagaggcccaccctcaggggcacattctctttctcagggatgttccttgctgagaaaaagaattcggcgatatttctcccatttgcttttgaaagaagagaaatatggctctgttccgcctgg

SEQ ID NO: 334747 - DNA, 2489 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaagtttcttcaaaggaaagaagcaactggaacacacatataacactaacccttccagctgcattatgagggaccagtacctgtctcaaggcaaaattatgacttagttcatcctcacctctggaggccagtaaaagtgggttatagaagaacaaagaggcatctagatctttcactgggttatttggagagaaacatctcctaccgaaggccagtttaacaagactggtagaggaggttatcttatctaattcacagaaatcaacacattgagtcaagaaaaatgaaacacagaaacactctaaataaaagaagataagtcttcagaaaccaaccctaatgaaatgaagatatgtgattaacctgacaggaaattaaaaagagcaaccataaagagtctcatgggagcaatgcatgaacaaactgagaattttcataaagaaataaaagataacaaaaagtataaagttgaagaatacaataactggactcaaaaatttaatgtgtccaacagaagaatcgatgaagcagaagaaagggctatcaaacttgtagataggccattggaaatcatgtaatgtgaggagaaaaaagaaaaaagattgaagatagtttaagagacttttgagacatcctcaaaggggaataatttatacattaccagatggagaagatagagggaaaaggacagaaaacatatttgaagaaataatgtcagaaaacctcataattctggcaaggaaatagaaatttagatctaagaatctcgaacatcaggtatgatgaatccaaggagactcacaccaaaccatattgtaattaaataaaggttaaagacaatcttcagagcagcaagggaatagtctcttcttacatacaaaatgatccacggaagactgtcagcagacttcaccagaaaactttcacgccagaaggcagtcgtgatatatacaaaaagctgaaaggaaaacactgccatccaggaatactatctccaactatcctgtgtttcaaaaattaaggagaaatataaagttctcaaacaaaagatgtgggagtttaccaccactagacctgcacgggaagaattgctaaagggagtccttcaagctgtagtaaaagagtgctaattagaaacatgaaaacaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctgtatatctatatgtgaaattgaaccattttctcatagcatatagaaaaatcaactcaaaatggattaaagcctgaaatgttgcctttgaaactgtaaaactactagtagaaaatataggggaaaagctctatgatgttgttctgggcaatgatttcttggatacatccttaaaagcatgggcagcaaaaacagccagacaactatcagggaacctgcccagatagtcacataggttcttttctattttccctaagcattggccgggttgagaaataaagggacagagtacaaaagagagaaattttaaagctgggcatcctggggagacatcacatgtcggtaggttccgtgatgccccctgagccgtaaaaccagtaagtttttattagggattttcaaaggggagggagtatacgaataggaggtgggtcacagagatcacgtgcttcacaaggtaatagaatatcacaaggcaaatggaggcagggcgagatcacaggaccacaggactgggttgaaattaaaattgctaatgaagtttcgggcaccatcgtcattgataacatcttatcaggagacagggtttgagagcaacctgtctgaccaaaatttattaggtgggaatttcctcgtcctaataagcctgggagcgctatgggagactggggcttatttcatccctacagtctcgaccatagaagacagctacacccaagggggccattttagaggcccaccctcaggggcacattctctttctcagggatgttccttgctgagaaaaagaattcggcgatatttctcccatttgcttttgaaagaagagaaatatggctctgttccgcctgg

SEQ ID NO: 334748 - DNA, 2355 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgatggagttcgctcttgttgcccaggctggaatgcaatggcatgaccttggctcactgcaacctctgcctccccagttcaagtggttctcctgcctcagcctcccgagtagctgagattacaggtactggctcctgtatcacccagctctggagttgaaagagctcttcattcctgagtctcctgtaccactgagaatagaaatcaacacattgagtcaagaaaaatgaaacacagaaacactctaaataaaagaagataagtcttcagaaaccaaccctaatgaaatgaagatatgtgattaacctgacaggaaattaaaaagagcaaccataaagagtctcatgggagcaatgcatgaacaaactgagaattttcataaagaaataaaagataacaaaaagtataaagttgaagaatacaataactggactcaaaaatttaatgtgtccaacagaagaatcgatgaagcagaagaaagggctatcaaacttgtagataggccattggaaatcatgtaatgtgaggagaaaaaagaaaaaagattgaagatagtttaagagacttttgagacatcctcaaaggggaataatttatacattaccagatggagaagatagagggaaaaggacagaaaacatatttgaagaaataatgtcagaaaacctcataattctggcaaggaaatagaaatttagatctaagaatctcgaacatcaggtatgatgaatccaaggagactcacaccaaaccatattgtaattaaataaaggttaaagacaatcttcagagcagcaagggaatagtctcttcttacatacaaaatgatccacggaagactgtcagcagacttcaccagaaaactttcacgccagaaggcagtcgtgatatatacaaaaagctgaaaggaaaacactgccatccaggaatactatctccaactatcctgtgtttcaaaaattaaggagaaatataaagttctcaaacaaaagatgtgggagtttaccaccactagacctgcacgggaagaattgctaaagggagtccttcaagctgtagtaaaagagtgctaattagaaacatgaaaacaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctgtatatctatatgtgaaattgaaccattttctcatagcatatagaaaaatcaactcaaaatggattaaagcctgaaatgttgcctttgaaactgtaaaactactagtagaaaatataggggaaaagctctatgatgttgttctgggcaatgatttcttggatacatccttaaaagcatgggcagcaaaaacagccagacaactatcagggaacctgcccagatagtcacataggttcttttctattttccctaagcattggccgggttgagaaataaagggacagagtacaaaagagagaaattttaaagctgggcatcctggggagacatcacatgtcggtaggttccgtgatgccccctgagccgtaaaaccagtaagtttttattagggattttcaaaggggagggagtatacgaataggaggtgggtcacagagatcacgtgcttcacaaggtaatagaatatcacaaggcaaatggaggcagggcgagatcacaggaccacaggactgggttgaaattaaaattgctaatgaagtttcgggcaccatcgtcattgataacatcttatcaggagacagggtttgagagcaacctgtctgaccaaaatttattaggtgggaatttcctcgtcctaataagcctgggagcgctatgggagactggggcttatttcatccctacagtctcgaccatagaagacagctacacccaagggggccattttagaggcccaccctcaggggcacattctctttctcagggatgttccttgctgagaaaaagaattcggcgatatttctcccatttgcttttgaaagaagagaaatatggctctgttccgcctgg

SEQ ID NO: 334749 - DNA, 1922 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaaggttggagtgcagtggcgcgatctcggctgactgcaacctccacctcctggattcaagctattctcctgcctcagcctgccgagtagctgggattacaggcatgtgccaccgcacccagctaattttgtattttttagtagagatggggtttctccatgttggtcaggctggtcttgaactcctgacctcaggtgatccgcccacctcagcctcccaaagtgctgggattacaggcgtgagccaccgcgcccggccagaacattagttttaaacttcctaacccttgggagaaggcaaaacacttgatgaaatctacataaagactaaaacattttaccaattttgcattgtttgtttgaaattgcattgacgactgatggagttcgctcttgttgcccaggctggaatgcaatggcatgaccttggctcactgcaacctctgcctccccagttcaagtggttctcctgcctcagcctcccgagtagctgagattacaggtactggctcctgtatcacccagctctggagttgaaagagctcttcattcctgagtctcctgtaccactgagaatagaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctgtatatctatatgtgaaattgaaccattttctcatagcatatagaaaaatcaactcaaaatggattaaagcctgaaatgttgcctttgaaactgtaaaactactagtagaaaatataggggaaaagctctatgatgttgttctgggcaatgatttcttggatacatccttaaaagcatgggcagcaaaaacagccagacaactatcagggaacctgcccagatagtcacataggttcttttctattttccctaagcattggccgggttgagaaataaagggacagagtacaaaagagagaaattttaaagctgggcatcctggggagacatcacatgtcggtaggttccgtgatgccccctgagccgtaaaaccagtaagtttttattagggattttcaaaggggagggagtatacgaataggaggtgggtcacagagatcacgtgcttcacaaggtaatagaatatcacaaggcaaatggaggcagggcgagatcacaggaccacaggactgggttgaaattaaaattgctaatgaagtttcgggcaccatcgtcattgataacatcttatcaggagacagggtttgagagcaacctgtctgaccaaaatttattaggtgggaatttcctcgtcctaataagcctgggagcgctatgggagactggggcttatttcatccctacagtctcgaccatagaagacagctacacccaagggggccattttagaggcccaccctcaggggcacattctctttctcagggatgttccttgctgagaaaaagaattcggcgatatttctcccatttgcttttgaaagaagagaaatatggctctgttccgcctgg

SEQ ID NO: 334750 - DNA, 1073 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaaggttggagtgcagtggcgcgatctcggctgactgcaacctccacctcctggattcaagctattctcctgcctcagcctgccgagtagctgggattacaggcatgtgccaccgcacccagctaattttgtattttttagtagagatggggtttctccatgttggtcaggctggtcttgaactcctgacctcaggtgatccgcccacctcagcctcccaaagtgctgggattacaggcgtgagccaccgcgcccggccagaacattagttttaaacttcctaacccttgggagaaggcaaaacacttgatgaaatctacataaagactaaaacattttaccaattttgcattgtttgtttgaaattgcattgacgactgatggagttcgctcttgttgcccaggctggaatgcaatggcatgaccttggctcactgcaacctctgcctccccagttcaagtggttctcctgcctcagcctcccgagtagctgagattacaggtactggctcctgtatcacccagctctggagttgaaagagctcttcattcctgagtctcctgtaccactgagaatagaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctg

SEQ ID NO: 334751 - DNA, 1304 bp, Homo sapiens
cttggcctgctctggtgatgaattcgtttctgcagactttccctgggagtaatttgtacacatactgactgccccatattttacatccctcattcaaggtactggctcctgtatcacccagctctggagttgaaagagctcttcattcctgagtctcctgtaccactgagaatagaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctgtatatctatatgtgaaattgaaccattttctcatagcatatagaaaaatcaactcaaaatggattaaagcctgaaatgttgcctttgaaactgtaaaactactagtagaaaatataggggaaaagctctatgatgttgttctgggcaatgatttcttggatacatccttaaaagcatgggcagcaaaaacagccagacaactatcagggaacctgcccagatagtcacataggttcttttctattttccctaagcattggccgggttgagaaataaagggacagagtacaaaagagagaaattttaaagctgggcatcctggggagacatcacatgtcggtaggttccgtgatgccccctgagccgtaaaaccagtaagtttttattagggattttcaaaggggagggagtatacgaataggaggtgggtcacagagatcacgtgcttcacaaggtaatagaatatcacaaggcaaatggaggcagggcgagatcacaggaccacaggactgggttgaaattaaaattgctaatgaagtttcgggcaccatcgtcattgataacatcttatcaggagacagggtttgagagcaacctgtctgaccaaaatttattaggtgggaatttcctcgtcctaataagcctgggagcgctatgggagactggggcttatttcatccctacagtctcgaccatagaagacagctacacccaagggggccattttagaggcccaccctcaggggcacattctctttctcagggatgttccttgctgagaaaaagaattcggcgatatttctcccatttgcttttgaaagaagagaaatatggctctgttccgcctgg

SEQ ID NO: 334752 - DNA, 1374 bp, Homo sapiens
tgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaaggttggagtgcagtggcgcgatctcggctgactgcaacctccacctcctggattcaagctattctcctgcctcagcctgccgagtagctgggattacaggcatgtgccaccgcacccagctaattttgtattttttagtagagatggggtttctccatgttggtcaggctggtcttgaactcctgacctcaggtgatccgcccacctcagcctcccaaagtgctgggattacaggcgtgagccaccgcgcccggccagaacattagttttaaacttcctaacccttgggagaaggcaaaacacttgatgaaatctacataaagactaaaacattttaccaattttgcattgtttgtttgaaattgcattgacgactgatggagttcgctcttgttgcccaggctggaatgcaatggcatgaccttggctcactgcaacctctgcctccccagttcaagtggttctcctgcctcagcctcccgagtagctgagattacaggtatgcgctaccacgcccggctaattttgtatttttagtagagacggggtttctccatgttggtcagactggtcttgtaggagaaatagacttcactaaaatattacagccaattagtaaaaataagacagtaaatagtaacaccttgtcctggagtgatagtagccagtattgctaccatatattactgacaatgtttaattttcaacaacaaaaataattgagagataaagagaagtaagaaaacgtgaccttatggggaagaagactggcaaaacatctcaactttgaaggcataagatgtgttactaagcagacaaatatttcaaattggccattataaatatcttaaaagaactagaggacaccatacctcaggaggcaatgatataattacaataattttgcaactagagaatataaataaataggtaagaattatagaaaagaaccatatggaaatctggagttgtaaagtataataacagaaattacaattcattagagaggtttaatactagattttaactggtagaataaacaatcattgaatttgaagatagattgatagaaatcacccagtttaaaaaatacagaataaagaagtaagtaaaatgcagtttcagagaaatggcagaagccattgagaataccaaca

SEQ ID NO: 334753 - DNA, 260 bp, Homo sapiens
ctaacaaacaacaatctatccaaaaaagtaatcaggaaactaatcacatttacactatttactaagtaaacaaacttatgaatgaatttaaccaagtaggttaaagatctgtatagtgaaaacattgatgaaacgaattgaagattacaaaaatagaaatttttctttgtacatggattgggaaatttatattgttataattttcatactgccaaaagaaacatacagattctgtgtaatcaatatttcaatgtcctttt

SEQ ID NO: 334754 - DNA, 449 bp, Homo sapiens
ggtgatctcatcaatttcattcatcagtgttttatagttttcattatagagatatttaacttctttggttaattcctaggtatttaattttatgtgtggctattgtaaatgagattactttttaatatctttttcagattgttcactgttggcatatagaaacactactgatgcctcagagatgaccatgatggtgttctggtgtcaggagaatagcaatgcctgggagtccaccaccaccataatctcctgtgatcccacggagctgcagtcagaagggagcaatgacaagaaataagtgctgagcagttgtcatatggtgctggaagacatgctacttttccctgagggcggaagacagcctgatgacggtggtacaatcaatgacatctctgtgctgggagtgacctgcttgggggcccaggctgatcatttcacacagacacccc

SEQ ID NO: 334755 - DNA, 350 bp, Homo sapiens
ccttgtttactaaaatagttatgtgaccttagacaaatttcctaacttctctgtgactcattttcttcatttgtaaaatggcgatgataatagcacctacttattatttacttgtagtagtaaagattaaatgagcttatacatagcaagtggtgaataaatgttagcattattatatatttagcctcaatttctggatgtcataagaagaaataaacttattcacagtttaagacctgtgtgaccagatttttcttagtttgtttgttttttctttgagatggagtctcgctctgtcgcaaggctgcaatgcagtggctcgatcttggctcactgcaaactccgcctcc

SEQ ID NO: 334756 - DNA, 326 bp, Homo sapiens
gctcccttcccctacttcgggatggtgtaaggtttccttgccaaggtccctgtggtgcagagtgggccaagtttgccgccttctggagcgacaacaaggagaaaacaggggtttaagtggaggatccggtgctctgatttctccccagttagtaaagcattcaggctgctcggtggaggtgggaagacaggcgctgagagttgtctgacacaattgtcttagcagcaggagacgctgatgggatgtcgggagtcaccaggaccatctgacaaatgaccgccttggggatccgtggagctcagcggtgcccagagagagcactcgaa

SEQ ID NO: 334757 - DNA, 319 bp, Homo sapiens
agaaaggtgctcagcctcaatctcaatctcaatctcaagcctcagccttgtatttatttgtattcaagtaaatacaaataaaaaccataagacattattttacacctactattttgacaaaaattctaaagtctaagaatatcaagtattggtaaagacataaagaaatgtgaattttcacccattacttgtgggaatataaaataacaatttggattaaagtttaacattacttagtaaagtcaaatacacacacacattatgatccagcaattctacttctaagtacattattggaggagtccccaacacctggctg

SEQ ID NO: 334758 - DNA, 965 bp, Homo sapiens
agcacactcagcggatggagggcctggcttctgcacgccggctggcacttgctgccagttgcccttttctgcgaggctggatcgtggtgcggtggtggcttggatgggtttctctgctgaacgatgatgtggaatgccttttcactgcttcttggtcgtcggtttttcttctttggggaaatgtctattcaagtcctttgccctttttttaaagtataatttccgtatttttttccccagaggatagtttgtctttagtccttaaggactcagctccttatgtgggtcttagtgggagtcgtgggcaacacccaggtctagacccaggtggaatgcatggtcttggggccttggtgggggtcgtgggcagcacccaggtctagacttgggtgacgtgcatagccctggacttgaggagcaggattcctgactggcttgctgtgaagggcaccactggggcagtgacgcagcttcacacgcagctcgggaagcacacagtcggcgcagatgcttccaaaatgtctgcaaggctgcggcctctactgcatccagatggtgaactgcctaactctaccgcgtcccgatggtgaactgctaactctgccgtatcccgatggtgaactgccgaactctaccgcatcccgatggtgaactgccaaacttttacctcgtcccgatggtgaactgcctaaacctcgtcccgatggtgaactgcctaactctaccgcatcccgatggtgaactgcctaactctaccacatcccgatggtgaactgctaactctgccgtatcccgatggtgaactgccaaactttacctcgtcccgatggtgaactgcctaactctacctcgtcccaatggtgaactgcctaactctaccacatcctgatggtgaactgctaactctgccgcatcccgacggtgaactgccaaactctacctcgtcccgacggtgaactgccaaa

SEQ ID NO: 334759 - DNA, 1356 bp, Homo sapiens
agcacactcagcggatggagggcctggcttctgcacgccggctggcacttgctgccagttgcccttttctgcgaggctggatcgtggtgcggtggtggcttggatgggtttctctgctgaacgatgatgtggaatgccttttcactgcttcttggtcgtcggtttttcttctttggggaaatgtctattcaagtcctttgccctttttttaaagtataatttccgtatttttttccccagaggatagtttgtctttagtccttaaggactcagctccttatgtgggtcttagtgggagtcgtgggcaacacccaggtctagacccaggtggaatgcatggtcttggggccttggtgggggtcgtgggcagcacccaggtctagacttgggtgacgtgcatagccctggacttgaggagcaggattcctgactggcttgctgtgaagggcaccactggggcagtgacgcagcttcacacgcagctcgggaagcacacagtcggcgcagatgcttccaaaatgtctgcaaggctgcggcctctactgcatccagatggtgaactgcctaactctaccgcgtcccgatggtgaactgctaactctgccgtatcccgatggtgaactgccgaactctaccgcatcccgatggtgaactgccaaactctaccgcatcccgatggtgaactgctaactaccgcatcccgatggtgaactgccgaactctaccgcatccctatggtgaactgctaactctgccgcatcccgatggtgaactgcctaactctacctcgtcccgatggtgaactgcctaactctaccacatcccgatggtgaactgctaactctgccacatcccgatggtgaactgctaactctgccgcatcccgatggtgaactgccaaactttacctcgtcccgatggtgaactgcctaaacctcgtcccgatggtgaactgcctaactctaccgcatcccgatggtgaactgcctaactctaccacatcccgatggtgaactgctaactctgccgcatcccgatggtgaactgccaaactttacctcgtcccgatggtgaactgcctaaacctcgtcccgatggtgaactgcctaactctaccgcatcccgatggtgaactgcctaactctaccacatcccgatggtgaactgctaactctgccgtatcccgatggtgaactgccaaactttacctcgtcccgatggtgaactgcctaactctacctcgtcccaatggtgaactgcctaactctaccacatcctgatggtgaactgctaactctgccgcatcccgacggtgaactgccaaactctacctcgtcccgacggtgaactgccaaa

SEQ ID NO: 334760 - DNA, 419 bp, Homo sapiens
gtagcacaatcttcagtaaatagactttgcaaaaactgcttttctggttgacttccagggcagccccaggaagcagcagagaataaaagtactgtctgcccctctcccacctcctccaaatccgatcccatttaacttccctggccaatgttgcacagtgagtccgaaccatataggagagctggagttcgagaggatctaaagacaagtcaccatcctgcttgaaggcaacaaaaagcctctgtccagctggtcgcagctgatctcccccagtatctccgcagtccttcccgaggccttctgcgtccgccccgccccctcgggctgcacaactcccaaagcccaccccaggcaaaaatcacgtccagaatctcgggtctttgttttccccgcgtagtagtagccgctcagcaaggatt

SEQ ID NO: 334761 - DNA, 497 bp, Homo sapiens
ctgggattacaggtgcccaccaccacacccagctaatctttgtatttttagtagagatggggtttcaccatgttggccaggctggtctcaaacccctgacttcaagtgatccacctacctcggcctcccaaggtgatgggattacaggtgtgagccaccgtgaccggtctagacaagcattttatgccttaattctaaacttaacttacaacccttcagcctaacatatctactgatacatctcacttctacaaatctgaactccagcaattcttcaaagacctatctaaagcatccaaaatctgtttctgagtttcaattacttctttttttttttttttttttgagacagagtctcgctgtcgcccaggctggagtgcagtggcacgatctcggctcactgcaagctccacctcccaggttcacgccattctcctgcctcagcctctcgagtagctgggactacaggtgcctgccacgtcgacccggctactttt

SEQ ID NO: 334762 - DNA, 117 bp, Homo sapiens
gtgtcatcacctactctcttgaccttggttttctgcatctcataagaatcaagagcagcagcaactaaggccagtcctagctagcaggttacaaaatactttttttttttttttttt

SEQ ID NO: 334763 - DNA, 294 bp, Homo sapiens
accttatacaaaaatcaattcaagatggactaaagatctaaacgttagacctaaaaccataaaaaccctagaagaaaacctaggcattaccattcaggaaataggcaagattttttcttttgcattggccttgaggaggatggttgtcctttatagtatctggcttaagttctctgtatttcttggatttgcatgtcaacctctctagtgagattagaaaaattttcatggactatatcctcaaatatagtttccaagttgcttattatctccccttctgtgtcaggaatgcca

SEQ ID NO: 334764 - DNA, 313 bp, Homo sapiens
gggtcccagcagggcagggattgtgttttacaatcttgaggtctccagcaccagtcacagtgactggtacgtactatgcacattattaaacgactaaataaaagaacttttacattcattgtctcatttgcacttcaaaatgtcaagcctagcattttagagctggggggtgacattagggattgattaatgcgtttattctattctttgagcacctgtaggtgctaggcactgttcggggcaaggtgtacaaattccagtgcggcaagaacaacacccttgagaagctgagagtctagtctgggagacgaga

SEQ ID NO: 334765 - DNA, 137 bp, Homo sapiens
actcaaaacttagtctctcattttctctatatttgtctctatttggttgatgtatctggactttttctaagtctctaaagggatgaagctgtgtacacttttagatcgtttcggaagtggttaaaacagcatcctgt

SEQ ID NO: 334766 - DNA, 213 bp, Homo sapiens
gtgcttttctagaagtggagggaaggaagccaagtgttattacagacttccatttaatgcccttatttttagatccacttctgcctcccagccttcattgtacctggggtttcaaaattccaagtctccggggttgggcagggtagatcagctacctccttccattggatagccctcagcaagagttccaagctgttactccctccacccagc

SEQ ID NO: 334767 - DNA, 511 bp, Homo sapiens
gtcccgcttctgggcagggcccaccctgacctgagatgtgtgtgtggctgacctcttgggaaaccctgaagccagtgtctgaggcaccccatcattttcaaggaacaggaataactggagaaacaagtctttcaaagtggttccaccttttgaggtaactgggagtgccttttcttggggtgactcagtcaggaaagtccccgattatgtacttaaggagtccttttctctccttttatggtagtctgcaaatagcagagagaagcccctcactctcgatgctccctgggtacctccctatggccccgctgctgccgactgcttcaacacattcttctgtccctgctgtttagatgccgtgttgtaggagcctgttgctagggtgtgttctgatgtgtcttccaccacctttaaacaagcagctcatgttccttttctctcccctggaatgggtcactgtgtaagcctttttcatagttcaagattccaggattgcccccaaataggccag

SEQ ID NO: 334768 - DNA, 388 bp, Homo sapiens
tttattgcttgattcagggtgactttctgcagaccctgtcaagtgtaagatgccatgactgcttctttaggaccaagctcacaatctggaaccttctttgtttccgtctctgctccatcccctctctccactgtggtccagaaccagggtcatagcttatctttattgcagcaggaggcatttcaaggcagaaacagcccattctatccaggtaaaccacaacagacgtggcatcatgtcagattcaatagctctttcatgcagtagctcccttcccttgccaggacataggccacgaggccagtctctgagcctatgagctaccgtgactgttcccaccttactcagtttccatcaattaactccattctcttccatcagcctgtcc

SEQ ID NO: 334769 - DNA, 306 bp, Homo sapiens
tctgtcttcttatttcagctcaaaaagtgttcttttcaaggcctatttgatgtcacattttttgcatttttgtgctttttttaattggtgatttcatgtttaaaatggcccccaagcatagtgctaaagtggtaactgggttcgacagcgtaagaaggctgtgatggacctcagggagaaaaatacatgtgttcgagaagtttcattcaggtatgagtgatagtgcttttagcctagagtttaatgttaatgaatcaacaatatatattaaatgaggtgtccttatacagaaacactcataaaata

SEQ ID NO: 334770 - DNA, 531 bp, Homo sapiens
aacctgacccactagacgcttcacttcctcctttcatggtctcatctataaaaatgagatgccacagatgacttccaagttgccacaggctggctgcttcaaatgcagacttcacccccaggaagctcacagttcagccagggagccatgatttgtacataagtgaaagaaatctcactccatgactgaattgggtgataactggcatcttaatcctcatctctgttattggcctttaaacccttgccacccagagaatgctttgcacagtgtctggcactcctggaagagtgagtgaggccagtgggtggtatggcatgggtgagacagggaggagtggggtgcagctctgccagttgcatcagttgcatcgggggcccctgcctggtgcatccatagcagcccagcctgggcagcttcctgtcccagcccggcaggatgcacctcacgtcacacagcgggaatcctcttgctgttatttacattgcttgcaaaatccaagaaatcatccctgaatatgtggcccaatgt

SEQ ID NO: 334771 - DNA, 391 bp, Homo sapiens
gtctgggcacagtggctcatgcctgtaatcccagcactttgggaagccaaggcaggcagatcacttgaggttaggattccaagaccagcctggccaacatggtgaaaccccatctctacaaaaatacaaaaattagccaggtgtggtggtacatgcctgtaatcccagctactcgagagcctgaggcaggagaattgcttggacctggtaggtggaggttgcagtgagctgaaattgcaccgctgcattccagtctgggtgacagagtgagaccctgtctcaaaaattaaataaataaataaataaaatacatacatacatacttaaccaggatgaaaaaaataatgaagagctacctaagaagaataactgggctctgatcttggtgaaa

SEQ ID NO: 334772 - DNA, 342 bp, Homo sapiens
agctggactccatcacttactagttctattaccttaggtaataggaagcctcggcttcctttttttgtaaaatggggatgttaacattgtctcatagggtcattgtgggggatcaaataagacgatatatacaaagctctcagcactgtgccctgcatatcaatgctgtaattactccaggatccagaggaagaacctatacccctcgcgctctctgggtttctgcacgctctgcccagtggcctggcacctcagctttagagggcaaggtagagccaaccattaatcagatagtgctgggaccggctggggttttctgtggcatcccgtatcttcccatca

SEQ ID NO: 334773 - DNA, 938 bp, Homo sapiens
gctcccggtgcccgctgcccgccgtccggtcccggctgctcgcggcccctgctcctgcctggtcgctctggccaggctcgggctccgtgagtgacaggaccgcgcgactggccggccgatccctgggccggctcgtgggagcagcctcctttgttctcctgtgcagggcccgggatggtgctctccctgacggggctcattgccttctccttcctgcaagccacccttgccctgaaccccgaggaccccaacgtgtgcagccactgggagagctatgctgtgactgtccaggaatcgtatgcacaccccttcgatcagatctattacacacgatgcacagacatcctcaactggttcaagtgcaccaggcaccggatcagttataagacggcgtatcggagaggcctccggaccatgtaccggcggaggtcccagtgctgccctggctactatgagagcggagacttctgcatacccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcgcctggcacccacggcaagggatgccagctgccgtgccagtgccgacacggtgccagctgcgaaccccgcgccggcgagtgccttctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgg

SEQ ID NO: 334774 - DNA, 681 bp, Homo sapiens
agcggactgtctagccactcgactctcctaccacactctgtattctctgcaaagcacttgcacacatcattggagcactatctgcggcacaggaaagcttcatcactctcattttccagatgagaaaattggagctctgagaaagtgaagttcacctgggtcacaccgcctgatctcccgactccgggttggatgattttgccatctggtcccctcagccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcgcctggcacccacggcaagggatgccagctgccgtgccagtgccgacacggtgccagctgcgaaccccgcgccggcgagtgccttctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgg

SEQ ID NO: 334775 - DNA, 510 bp, Homo sapiens
ggccttatgaataacacacaaatacccgtgggaagagagcctagggtcttaatgacaacaaatccattatatgaaattaaaatgaaaatgctattttgccattaaaatgctaaaatacagtcttaaacatataagaaatgggtattcctacatagtgttgacaggaatataaattttataactttgtagaaagttattaccctgtttgtataaaaatgttggaaatattcttgtagtaattccactgaaggaagtatattctaagggaacagtcacacaacaacaaagatctctgtacaaagacatttacaaaagcattaatagagaaaacactttttaaaaattactctatataaggatattggttaattttggttggtgtatttttataatatacacagccattatgaattaggtttattttcagtagtagttattgatgtggaaagtatacaatattaaataggaaaagcaaatttcttggatatggagcaatgataatgatccctt

SEQ ID NO: 334776 - DNA, 440 bp, Homo sapiens
gaagtggtggagctggagcctgctgcatgggagggttctgtggagtgagatgagatgttttacgtcatgctcttttcacaccttcttggcacccagaaagagctcagcaaacattagctgctaccagccaccctgactgtggctgtcagccagcattgttcttcccaggccctgccctaccctcctcctggcatagtgtctctcagggcataggaaactttctcggccagattggccatgggaggctttcttggggaccagagagtctgcagggagggcaagtcaagagcaggtgagagggagggaagggcgagcaggacccttgacctcattctcggctgcagtgtatattggcctgcctggtgaccctccttgctcctggtcccactgccaaacctctggagtctgccacatccctgcatagacagggccactgacag

SEQ ID NO: 334777 - DNA, 460 bp, Homo sapiens
tcacttgcccaagttcccagagctgacaagtggctgagcaggatttggatgttagtctatcttgcatcaaagtccacactccttcccgtagtaatctgggcagcttctccactctccacccacattccctccccacatatgtaggcatcttgcccttaaaaaatattcaaggctgaagctgccttacatagagtattataattaagagactgggctctggtgtcagacatttccaggcttaaatcccagctctaccacctgccaactgagtgcctcagtttcctcacctgtaacttagagacaatcatggattttgatttcgggggctcctatggggatttggtgagggaatatgcacttagtacatgagtccccacatggtagccagagtctgatgtcattgctggacagtgtcctccaaaccaagaaagctaatgaacactgggtcatgcctattgcc

SEQ ID NO: 334778 - DNA, 320 bp, Homo sapiens
ccgagctatttttatgtataaaatattttggggagacagagtatgtgctctgaatttcaactattgttacatagtgacagggatcatccatctggccctgctcagatgtcaccttgtctgcaagctcttcctctgttctcctaatcccaggtgattgttctttgtttttgctcctgtaaaatcctcttacagtacaagccatggtctgacttacagtatggctgtgtgtatatttcttttattagattgtggagtttgctaaaattaacagaagttagagccctttcatttttactgttgcctaaagtacttgggcagtt

SEQ ID NO: 334779 - DNA, 214 bp, Homo sapiens
aggaaaaaagtttgtctttgtcactttaatcttatcattactagagaatatttatgaatattttagaataatatatttttaagcccaaatctcaccaaatgttttttctaaaacaaatactttttgttgttgtttgtttttgttactgtgtctcactctgtcacccaggtatggagtgcagtggtgcaaccatggctcactgcagccttcacct

SEQ ID NO: 334780 - DNA, 472 bp, Homo sapiens
ccttcttagaggagataccgattgaatcagatatcttaaagtatgagtaaatgaaaacttgaaggggtgacttggaggacttcccactctagagcattataagacaattcagagctgaacagatgttggagtaggcattggtgagtatgacacctacaagaaggtcctagtcactaagacacagaggaagagcgatggctcttacctccccaatcaccagaggatgtttcattttggatatgttgaaattgaggtatcactgaacattgacttggatatatcctacatgtagttggaaatactttcactacattcaagggaggggccagggtcagagacaatgaagtgtgcagctcctatacccaaacagcagtgaaaatccaaggaatggatgagacttcccacagagtgggctaagagcttcaagtcaaggacagaaccaacatataaggggttagcacaggagagaaag

SEQ ID NO: 334781 - DNA, 384 bp, Homo sapiens
atgagtcaagcgaacagacctttatgtattacatgaatgatgaagtatatggatcatttaatcaatcctttatgatcatgcacatgtaaagcccctgctgcaaaagagacctagatcagtgagaagtattattcatccagtatatgggaagaacatgtgatggccttgatcagattgttgagcactgtgatctgcccaaaatatatgtaggtaattggatgctctttaaaaacatgggcgctgacactgttgctgctacttgtacttttaatggattccagaggccaacaatctacatgtgatgtcaggaccagcatcgaaactcatgcagtgtatctagaagcacgatctcccaccccaagtagaggaacaggacattagcat

SEQ ID NO: 334782 - DNA, 274 bp, Homo sapiens
tggtcattgtttaagagctgcccacagtcccattaccttttgagactaacatgaggctgacaaaaatgtcaaaagaaaaatgaaggaatataatgtccatatgggctttggaagtcttcaatatctctctgagaatctagtcatgtctatgtgcagggctgtgtgcatgccctggaaagacctgtgaaggctctaatctctcgtcggggctggtcttgaggctctgtgccagcagtaagtgactgttttaaagttgtaaactgcttgctagaga

SEQ ID NO: 334783 - DNA, 277 bp, Homo sapiens
ccaacatcagagcactgaaatacataaaacaaatattgacagagctaaagggagaaattgacagcaatgctatcataggaggaaactttaatgcctcaatttcaataatgaatagagcactcaagcagaaaatcaatttttaaaaacccgacttgtgcactctagcctaatggaccccacaaacatatctataactttccacccagcagaagaagaattagcccatgcaacaaattcttttcaaacacacttggaatatcctccaggacagatcaca

SEQ ID NO: 334784 - DNA, 183 bp, Homo sapiens
ttagctaaaggaaaccaaatacttaaagaaaatcagattcctcaataagattaacaggagttttctcatcagaaaacatggaggttaagaaaccagagaatgggcagatagacggatggactgactgaccaatttttttttttttttttttgagacggagtctcactctgttgcccaagctgg

SEQ ID NO: 334785 - DNA, 446 bp, Homo sapiens
cttgtttaccagctttgtttcaaatgactcttggcaatttccagaattgatcctaaaatggataaaatccctatctgtaatcaaggtatttgagacaaatatgtatgacaagttctcatgagtttcaaagtatgtggaacaatgacagtattgtaggaatgtgtatataagttccaaaaatacttgacttttaaataatatccattttgcaggagtcctgaatagcctcacgtaacacttcactgaaagtctgctatccagagatgtgtcaaaagcagtaactgtgcttggctgagtttgtaataatcaaagtgttaatcagctgtccccaagcttcctagctactgatacgaaatctaaaaagatgggctgggtgcagtggcctagattctggtcttgaaagctatcaatactttcctctgctttcaagacaaggtagagccgag

SEQ ID NO: 334786 - DNA, 1384 bp, Homo sapiens
  misc_feature (1384)..(1384): n is a, c, g, or t
gcgggagcgtctgtacctctgcggcgtcactgggagcccgacggaaaactgcgctaaaggcttgtctttcccctgcccgaccgaaggagccgaccttgcctgcgctacagcttccttattttcgtcgcctgttctcctgatcctgcgtgttctaaaaaccccttaggctttccatgggttcccagaccatggcggtggcgctgcccagggacttgcggcaggacgccaacctggcaaagaggaggcacgcggagctgtgcaggcagaagcgggtcttcaacgccagaaacaggataattgggggagacactgaagcctgggatgttcaagttcatgaccagaagataaaagaagctactgaaaaagctagacatgaaacctttgctgctgaaatgaggcaaaatgacaaaatcatgtgcatattggaaaaccggaaaaagagggataggaaaaatctctgtagggctatcaatgacttccaacagagctttcagaagccagaaactcgccgtgaatttgatctgtccgaccccctagcccttaagaaagatcttccagcccggcagtcagataatgatgttcggaatacgatatcaggaatgcagaaattcatgggagaggatttaaacttccatgagaggaagaaattccaagaggaacaaaacagagaatggtctttgcagcagcaaagggaatggaagaacgcccgtgctgaacaaaaatgcgcagaggccctctacacagagacaaggctgcagtttgacgagacagccaagcacctccagaagctggaaagcaccaccagaaaggcagtttgtgcatctgtgaaagacttcaacaagagccaggccatcgagtcagtggaaaggaaaaagcaagagaaaaagcaagaacaagaggacaacttggccgagatcaccaacctcctgcgtggggacctgctctccgagaacccgcagcaggcagccagctccttcgggccccaccgcgtggtccctgaccgctggaagggcatgacccaggagcagctggagcagatccgcctagtccagaagcagcaaatccaggagaagctgaggctccaggaagaaaagcgccagcgagacctggactgggaccggcggaggattcagggggctcgcgccaccctgctgtttgagcggcagcagtggcggcggcagcgcgacctgcgcagagctctggacagcagcaacctcagcctggccaaggagcagcatttgcagaaaaaatatatgaatgaagtctatacaaatcaacccacgggagactatttcacacaatttaatacaggaagtcgataatgaggaacacacccttgttcccgtcattcacgtataaagagtggctaccttaaagagtcacn

SEQ ID NO: 334787 - DNA, 318 bp, Homo sapiens
cttgaactgaaagttccctgaagcagtgacccttgtatttcctgatatggctcaaaacctgacagagttgtctgaagaggaacctccagaaaggcagggggaaaccagtagagttcaagggagtagagtgtgttaaagaatggtgaatagtcttacatgttgctttgtgtaaattctttggtagtaaaccgatgtacttcttcaagtgcatattgtagtgagtcaaaaaatttgtgaatgaatgagtgatgaacgaatgaatgcagagagtaaggtaaggcctagaaagggttcttttgcaagagtaatttcacatat

SEQ ID NO: 334788 - DNA, 306 bp, Homo sapiens
tttccctcataatgcaatgaataaaactttaatctttctcttcaggataaataatttctgaggctttagaaccaccttaaaaggtatctctaggccgggcgcggtggctgacgcctgtaatcacagcactttgggaggccgaggtgggcagatcttctgaggtcaagagttcaagaccagcctggtcaacatgctgaaaccctgtctctactaaaaatacaaaaattagccaggcgtggtggtgcacatctgtaatccagctactcagaaggcggaggcaggaaaatctgaatccgggaggcagag

SEQ ID NO: 334789 - DNA, 247 bp, Homo sapiens
cactcagtcagggaggcctgacttctgcctgtgtgcctccctctgctgtccgccagtgcgcctccgtgcctttgtctcttgtctcactgcctctttctctgcctcagtcaggctctctctcggattcctcctcctcctgagcccgttcctctcctcctctccattctcatcagagaggaacactcatccctctcttccagaaacaatggagcaccatgctcctgtccgctcagcctttcgggtggtg

SEQ ID NO: 334790 - DNA, 380 bp, Homo sapiens
gaaggaaggaagggaagggaagaaggagagaggaaaagagggaggaaaggaaggaggaaaggaaaaaaggaagccgagaaggaggaaggagggaagaagggagggaaggaagaaaggaaagaaggagagagggaaaaaagagagatgggggaagaataaatggggctttcttctcaagtacgaggcagttttcttatggtttgaggtgcaacagtggcatgagtggaacaaggaaaactagatcctttcatgagcctaaagaattcacctgctccacagaggcaatgaatggacagcaggacattccctggaacagatagcctgggtttcaatactggctctaccactaccagctgtgtgaccttaaggaaactacctaa

SEQ ID NO: 334791 - DNA, 144 bp, Homo sapiens
ttcacatacactgtttcctttgggcctcaccacataagctgaggttagaatttttaattttttttttctttgtgagatagggtctcactctcacccaggctggagcgcagtggcataatcacagctcactgcagcctcgacctc

SEQ ID NO: 334792 - DNA, 240 bp, Homo sapiens
ctgtaatcccagctactcagggagctgaggcaggagaatcgcttaaacccgggaggcagaggttgcggtgagccgatatcatgccattgcactccagcctgggcaacaagagcaaaattccatctcaaaaaaaaaatgagttttaacacactatagaagaatgggttaaattgtcactgagacttataagacagaaatagactttaatagtgtatcttttacttagctttcttgcttgct

SEQ ID NO: 334793 - DNA, 251 bp, Homo sapiens
cctcccaagtagctgggactacaggcgcgtgacaccacgcccgggtaattttttgtattttttagtagagacagggtttcatcgtgttagccaggatggtctcgatctcctgaccttgtgatccgcccgcctcggcctcccaaagtgctgggattacaggcgtgagccaccgcccccggccagccacaggtttcttatctgtaaaatggggatgagaacagcctgacctcctgggttgccatggtgattga

SEQ ID NO: 334794 - DNA, 428 bp, Homo sapiens
ctgtatccatatctatgcatctgcccatctatccaggtaactatataaaatattacatatgacatcatggccatactttcatttccgttttgtggggaagaaaagttatttcctaactacatcatttcccctcaagatgatctcaattttcatcataaaaggcttttacttttgccaagaaaataatgtgaaagtactctgaaaaagcatctgaagcacatgaatctgttcttattcgtagatttaaaacatcttggaagttaatgaaattgtcttccgttagggatttctgttaagtaagtagattttagctgttcttgtcaccacaaaaaaaaaaaaaagttaactatgtgagataataggtgtgttaacctcttcactagactgtctaaatgtatctctatgtctctgtgtatcccacaacatca

SEQ ID NO: 334795 - DNA, 294 bp, Homo sapiens
atctattctagctataggactcttacaacttaataaaagagaaaacccacctgggtgcactggctcacgcctgtaatcccagcactttgggaggccaggcggacggatcacttaagcccaggagttcaagaccagcttgggcaacacagcaaaaccctgtctctacaaaaaataccaaaataattagtcgggtatggtggcgggcacctgtggtcccagctaatcgagaggcagaggtgggaggatctcttgggcccaggaggtggaggctgcagtgagccaaaatcagaccat

SEQ ID NO: 334796 - DNA, 536 bp, Homo sapiens
gaaaagatggactattttggctaagcatggtggctcatgcctgtaatcccaacactttgggaggccgaggtgggtggatcacaaggacaggaaggagttcaagaccagcctgggcaatatggtgaaatcctgtctcttctaaaaatataaaaattagccgggcatggtggcgcacctgtagccgcagctactcaggaggctgaggcaggaaaattgcttgaaccccgggaggtagaggttgcagtgagctgagatcatgccactgcactccagcctgggtcctgctaccttgaaggacagcatagctaaactgcgtggcccaagggacagcatgaatgcagaatatagctttcttcacttgtggcctatttgcatagctgcccaaggcctccagtggacgacttcatggctttgtggtcttcatctgtagcatggatactacagattgtgggttcataggtcagctgggtacagggcagtttttataacaacctctggtgggtctttacattagtgtcaatatcacactgaaagat

SEQ ID NO: 334797 - DNA, 378 bp, Homo sapiens
atcaccagcatttaagttctgattctgtggccaggcatggtggctcacgcctgtaatcccaacactttgggaggccgaggcgggtggatcacgaggtcaggggtttgagaccagcctcgccaagatggtgaaatccttctctactaaaaataaaaaatcagctgggcgtggtggcagacgcctttaataccagctacttgggaggctgagggaggggaatcgcttgaacctgggaggcagaggttacagtgagctgagatggtgccattgcactccagcctgggcgacagagcgagactctgtctgaaaaaaattaattaattaattaattaattctgattctgcttcttctaagctgtgtgaatgtgtgcaagctgg

SEQ ID NO: 334798 - DNA, 629 bp, Homo sapiens
gcgtccgtggaacctcctgcaccctactcccagggcaaacccccagcgtccctccgggagccgcggagccactggccgcgctcatggctccaagccaatgaaccagggaaggtggaagggacggagactgggaaagtgtctgaggaccgagagctccgcggaaacggccgactgccgcttcctggcgcagtgggggtgtctgcggtatagggatgttcgcgtcctgatccgggacgcgatgccgcgacctgcggccacctagacgcgctcagcggcgcccgccccacccggatccccgaaaagggaaagaagtggctctcctcacttatgcggcaggttgagctgtttcctgagattcccgccagatcaccctccctgaagttccctccaggctcctccacaggggctcccctggacctcctgtaaaacattcacagcctggtatactgatatattctgagttaaaaacagagaaattgtagtttcagaaggagcaatccgacctgtttcttctgcatggagcatgccagaaaccttactctgggggagtatccttctgtaccagggcaagaaaacagccctgagaagccacaagggaccagaataaacatacgtaacaaagtcatctg

SEQ ID NO: 334799 - DNA, 881 bp, Homo sapiens
cagaaatattgtgtcaatgttttgatgttttactgactgttttttttagtacgtagattcattcatttgtacattcatttaataaatatttattgagcacctatcatgtgccagacactgttttaaacactgaagatataatgatgagcataaactttgtctttttagactttatcatctggagggtaagatgaggaaacttggagaatgtagtaatagataaatctgggaagagaaaaagggactgtaccaagtagcctcttgtaagccatagtaagattccctttacctcaagagcaatggaaagagagttgcattttgaaaagtttgttttcttagcaagccaaagaaaaagctattgtgttccaaacaaggcaaaaatgtttgaatcagagcagttatgatggagagaagttggtgaattccagaaatatttaggatgcaaaatctgcatgctttggtgatgaattggacatgggagaaagaaggtgtcaaggatgactcctaggtttctggtttgcacactgggatagtggtgccattcagtgagataaggactgcagtaagatcacatttgtagggaaggtcactatttcaattttggacataggcctttgagatatccaaaagaaaatgctcggtaggccactgcatatataagtgcagtcagtacatttgagaatcatttagtagctgatggacgtaggcatggcagtgtttcaaagaggggcgagatcaggaatatcaaatgcagctgagaggtcaagtaagatgggaaatctgtttgatttagcaacatatgtacatcattggtgacttgagcagttgctgttaggggaatgatgtgactcagtgccaagactgaagtagattagagagta

SEQ ID NO: 334800 - DNA, 381 bp, Homo sapiens
gcaattactgagggactatcgaattccagtaggcacagaatagagatggtggtgccatttagtttagcagaagtggacaaataagccagtcgagtcagctttgctctgaagctgcaggatttgctgtaacatggcagtggtcttgtaagcacaagccgtaagtggaggtgggtaaggggacagggactaattggagtaaacatgttaggactgtgggcaaagcaacatgtaccaaactcaatacagtctcctttacctaagacagtcagcacacaagtaaaacaacagatatagtaattcccctgcaaaagacttcttggtcactgtaaggattttaggaagcaggaaaagaaaccgaatggacagaaaagtgtcattaaa

SEQ ID NO: 334801 - DNA, 399 bp, Homo sapiens
aggctggatgagggccctgaagctgtcctttgggcaggggtgccaggcaggggacccaacagagcgccaagtataaagctggttggggtggggcttaaggatgggaggagtggacttaggaggtagagagtgctttgggtgtaggccaggtaagtttctggtctgcctgcattaggcacttggtagctgttagctatgccagtaaaaggatcttttacttttctggcaagactctgcaagaccggttctctcttaggtgattctcaggtggggatggggagggaagatgtgaaatttagggaaaataaaactacctttattacctacactatttccacctgattcatttaaaattatgtctaagattataatttgacacacatttttcaaaagagctct

SEQ ID NO: 334802 - DNA, 200 bp, Homo sapiens
tcgtcatcaatgttacgttatacctattttactaaaatttaaaaaaaaagctctgtctgccaacaaaaacaatgcttttaaaacaatttaccagttaaattaagcatttccaaaatatatttgattcaggaagattcacaattttcctatcgttttctgaacacagtgtttcttcagatttttcatctgcaaaatgaaaa

SEQ ID NO: 334803 - DNA, 453 bp, Homo sapiens
ccaaaacatggggtccaagatcttctgttgttgccgcaagaccagcgaggggtcttccaccactgttggcttccacaatccaagaatgttcgaacagcatcatccacggtccttcaatctgaacacaaattctctccacagtgctgtaccaaaaagacatccacgcctcccctatgacaaccgcatgatgctcaaggcgtgcatccttaggaggccatgagcattctagccggcggcacccacgtggtccctgcggctgcacagctgctgggcttccatgaggaagagggcagtggacaagagtcatgaagactgattcagaaactcccctgcaggaggagaagacgtctgagccatccctgtgccaccaccaagagtcactccagcttctgaaaaagccaccgtgggggggagccgcctccaattaaagtccttggtcacatcaaaggaagt

SEQ ID NO: 334804 - DNA, 411 bp, Homo sapiens
gtgctgtggggtccctagagacctgaaactcacagcccagtggggacagcccaagggcccttttctttggctcctgcttccctctagaggcggacactgtgctgtaccaaaaagacatccacgcctcccctatgacaaccgcatgatgctcaaggcgtgcatccttaggaggccatgagcattctagccggcggcacccacgtggtccctgcggctgcacagctgctgggcttccatgaggaagagggcagtggacaagagtcatgaagactgattcagaaactcccctgcaggaggagaagacgtctgagccatccctgtgccaccaccaagagtcactccagcttctgaaaaagccaccgtgggggggagccgcctccaattaaagtccttggtcacatcaaaggaagt

SEQ ID NO: 334805 - DNA, 522 bp, Homo sapiens
gtgctgtggggtccctagagacctgaaactcacagcccagtggggacagcccaagggcccttttctttggctcctgcttccctctagaggcggacactggtaatgcaagaaacaccacacccacccctactctgtcccagccagcatctcagtgatattaaacgcctactgtgtaccgcataccctgcaaagcacttgacatctttatgtcaccaaatccttacaacggcattctgcgggtaggtttcaccataccactgcacagactggaaaactgaggttcaaggaagctaaacggcccgaaattacacagcaaggtgcaacaggaattaagaactgaagtccatctaagtaaaaaaggagtgtgctcttaactgttatgctgttctgccaggcttcagatggagcctttccatttaaaaaccacttaccatcaactcttggagatcaaggtggttctgaacatctcattctggaattgtatagacggaataaaatctggcttcagataaaactacaaaa

SEQ ID NO: 334806 - DNA, 428 bp, Homo sapiens
ccaaaacatggggtccaagatcttctgttgttgccgcaagaccagcgaggggtcttccaccactgttggcttccacaatccaagaatgttcgaacagcatcatccacggtccttcatgctgtaccaaaaagacatccacgcctcccctatgacaaccgcatgatgctcaaggcgtgcatccttaggaggccatgagcattctagccggcggcacccacgtggtccctgcggctgcacagctgctgggcttccatgaggaagagggcagtggacaagagtcatgaagactgattcagaaactcccctgcaggaggagaagacgtctgagccatccctgtgccaccaccaagagtcactccagcttctgaaaaagccaccgtgggggggagccgcctccaattaaagtccttggtcacatcaaaggaagt

SEQ ID NO: 334807 - DNA, 557 bp, Homo sapiens
  misc_feature (125)..(125): n is a, c, g, or t
  misc_feature (130)..(130): n is a, c, g, or t
  misc_feature (155)..(156): n is a, c, g, or t
  misc_feature (158)..(158): n is a, c, g, or t
  misc_feature (166)..(166): n is a, c, g, or t
  misc_feature (171)..(171): n is a, c, g, or t
  misc_feature (191)..(191): n is a, c, g, or t
  misc_feature (200)..(200): n is a, c, g, or t
  misc_feature (275)..(275): n is a, c, g, or t
ccaaaacatggggtccaagatcttctgttgttgccgcaagaccagcgaggggtcttccaccactgttggcttccacaatccaagaatgttcgaacagcatcatccacggtccttcatgctgtacngcganaggaggtacaggacgaggcgttggnntnggggggtngggtngtgttggggccagtggccanacgaggggnggggggggggggggggggggggggggggggggggggggggggggggggggggggggggggggggggggggggggnggctacaacgcgcatgatgctcaaggcgtgcatccttaggaggccatgagcattctagccggcggcacccacgtggtccctgcggctgcacagctgctgggcttccatgaggaagagggcagtggacaagagtcatgaagactgattcagaaactcccctgcaggaggagaagacgtctgagccatccctgtgccaccaccaagagtcactccagcttctgaaaaagccaccgtgggggggagccgcctccaattaaagtccttggtcacatcaaaggaagt

SEQ ID NO: 334808 - DNA, 516 bp, Homo sapiens
ctgtgtccttattttccaaatcccatctttactagctaacattattaagcgctatgtgccagcacggttttaagtcgtttgcatacacagtatcaactcatttaaccgggtgcaacaactctgtggtaactaatattatcattctcattttataaatggggaaactgaggtatagaaagactatgtaacctgctcaaggtcatatggctaggaagaggtggagctgggacaccaacccagacagtcacaccccaaaaccactaaactacactcctcccatcagttttcctctctagaggctgaggtcttcagctcttcacctccagattttccaggcccaatccctcagaactggtctcctgttacttaccataagagcagctgttgaaggttacctaggagggaaagagtaaggaagaaaactaccccaatttcactttccttgccctgccacatcccagtcccagccctggccacactcacctccctggcactgcccattggtatcaggctctg

SEQ ID NO: 334809 - DNA, 576 bp, Homo sapiens
atcctattccttcccaccaatatttcagcaattttttccactttatttctttgctggggttgaagggagaggtctaggctggaagatacacatttaggaccaattaatacatagatcagatatagataggatttaaagttatgaaattgaatgaaatggccaaagaactataaatagagaaaaatgtctcctccaatacttagaggttggggaaagttagcaaaaaagaaacagcaaagaagcagcagccagtgaggtaggaagaaagccagaaaaacgtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagaccctgccccctccccttcacaccataactaggatacagta

SEQ ID NO: 334810 - DNA, 600 bp, Homo sapiens
tggatcacagattgggctcctttacccatggagaagcctatgctcacatcataatgcaaaaatatttttttgagtgtgtctggtgacatatcaaaagttagccttgccatagatgtatagcgtaccatttttttctcaacccttgaattggggttggagaggaagagaaaaatcttgccctgctatttaagggacagctttcttttggtctctttacacattttggcacataaatggagtttatgtgcatatggcttcctttatttttatttaaaaaaataaatctattaccctgtggataagagaccttggcagtaagattaaaagcattgtagtagagaacatattttacaggaacatattttacagaaatcaaatctgtagaagcttatgtaaaagctatccttccaaattgacaagtatgtaagggaatttttaaaccgttttttttttcttttaaaatccatgtataaagtagctacttaaaaataagatttaatgaggtaaggaatagtagagagaagagacaacaactagtggattttaaaatatttttctttgtttaggtgatttgggaaactggtcatccaagatacaacc

SEQ ID NO: 334811 - DNA, 255 bp, Homo sapiens
ggctttgtttgcatagaccatagaaaatgcttgagtgtacattggagaattctgtgaggtagaagtaacctccctgggatgatgcttctgtattcagtgatgagcagccacagtttctccctctttccctgtctcctcaagaggtagtttttttgtttgtttgtttttagacggagtcttgctctgtcacccaggctagagtgcagtggcgttcctcatcccagtgacgttcctcatccttttgacgttcctcat

SEQ ID NO: 334812 - DNA, 459 bp, Homo sapiens
aggccaatcagcaccccaccctgagatatcataatcattagtccttagcctgcctttcttcttcttcaacaagtcacttttatgattcaattaccatttccatattgatgaattccacattgatatttcaaggtctgatgtgttgtgtgaaatctttggctccttcccctccttatctctttatgcaggtaaacattagactctaatcatgttatttctcaagatgttaaactgtttccttcttttcattcccatgttaccactacagtggtagatagctatggcctgcagtccacatatagccctcgcctgtttttctaaataaagttttactggaacacagccatgcttattcatttatatattgggtatggctgctttcttgctacagtggtggggtcaagtagttgccaccaagactatatggcctgaaaagcctaaaatatttatttaagtttt

SEQ ID NO: 334813 - DNA, 227 bp, Homo sapiens
tcacagggtgaaataaaaaaacatgggcaataaagaataaactgaatgagaacagaatacaacctaggtctccattttctcatctgcaaatgagaaaaagtaggtgccaaacctgactgttccatcagaatcccatatggggatattccataaaatataggttattagtctccactcccagaatattttgatttattttgtctaaggataggacctgagaatctgca

SEQ ID NO: 334814 - DNA, 985 bp, Homo sapiens
ggagagttttactcactaacaggtcctttcctggaagaaataacctcatctcctgccatattagtttacaataaaaatcattccaaagtgagccatttcacattgcatttttgccacatgcacatttgctattgaaaccacagattctcagcataagtaagacataggtgtttcagaaacttcataaatacacgatctttcaggtgctcctcaatttcttaatcaaggtatattgaactccagtgattaggatagaacctgaaaacatcctttgttctattggatagtacaacacagcaagagcacacagttatttgtataataaaacaacttaattaatgaggaagatgggatgtttgattcctgctaccaccagttcacttcacaaaggccttcttctggtattaccaggaaaactttcctgcattttctagggaaaaagaaaagtcgtttattaggagcacaatgcagatatgtatctgtgttttcatagcttcagcaaacttcttagtaaaattcccatttcaacaaaaaccaaaatactgattgtttgaatgtagaaaggtatagaataaagactacaaaggggaattttaccagggctccttagaccagcttccccagcataatttttatataactcaagtaagcctctgcttcccctctcctttccagtataatataagaaggtcggaactgtcgcacaaaagaacttgatttcaatatgaaaatataatatgtaattttggggactgcagactttctgcatcaaagatctggacagccttaacttttataaaaataatttttcaatgttctcttttactaaccaggaaaacaagatgttttctgaaattaatgactttttctattttgggtctgttttctaagtttttacaggttgaggtataaagggtcgtcttctcctcatattgcctcttcataatcacctggggctattttttgcaagtcactgcatttttac

SEQ ID NO: 334815 - DNA, 124 bp, Homo sapiens
tccacaagagagagggatgatgtattcaaaatgctaaagcagacaagcaagcaaacaaacaaaaatgccaatcaacaatactgttcccggccgggtgaagtggctcatacctgtaatcccagca

SEQ ID NO: 334816 - DNA, 117 bp, Homo sapiens
attgagaaaagaactgggccaagaggaaaacaagtaagaagctactatgataggattcttgatttcaaagaaaacaatcggcttctcgctcccccctgtcacatggtttactctgta

SEQ ID NO: 334817 - DNA, 388 bp, Homo sapiens
tctcctccattgcaaggaactggcaccatctatcatccaagccagaaacaacatcctccttgagtgctctctttctcacttgctgcacccaattttggccaagttctgctaattctggctccagaacagctctcaaatctctccccgtttcttcatcacgactaccagaccctactccagttcccattgttttgaggctggatcttggaattgcttgctcaacaggggtccctttatctagaccagcttccaacaaaccattttccaaagtaagccatagagatcttccttcaaaattgcatgcagaccaggcacagtggctcacacctgtaatcccagcactctgggaggccgagctgggtggatcatctgaggtcaggagttcgag

SEQ ID NO: 334818 - DNA, 267 bp, Homo sapiens
ttgtccctgtagcttatttggattttaatagatttagcagtatagaaacaacttgctaagttattttttttatgagaactatgaaatgtgtatatgttcgtggattacagaaaacatttgttgaatggcttttactttttagctaaacacattttattttggctgcagaacgtgacggtctcataacttatattttctacactgctaaatttattaaaatccaaataagctacaggacagccatttaggtaacagacatttaggtga

SEQ ID NO: 334819 - DNA, 946 bp, Homo sapiens
cctttattcccgtaggtacagttcctacattgaaaatgtccagaatattatttaaaccttgactgctctctcgatggcacccagccttcatcacttacatggctgagtttgttcattcttaaaacagtctttggattttaaactaaaatatttatcaaacccaagtctatagtaagtgtccactaaatgagcaaacaggaccatgtaaaactaatgtctttctttaagtggaaagttaacacttcttaaagcataagctgactccttactattcctattttttaattaattttggtttttaaaaagattaggccatcctaagcagaaaactataaacaaaattgctggtatataaaagcatagaatttggaattaaatccaggaaaccaaagggcacagagctgaagacccaagaattctcctttcattgcgtgaactgcattgccattcatggcaggtaaaactgtctgaaacaaagacctgaagtccttaggtgagtggcagtagaagctgctgccagtgttgcctagcaggaaaggaacttggagcaatcagggaatcagaggtgctgtggaccaaaagcccatatgggaatccttgtgcttctccagagcctagtgagagccacctcactccacctttacgtttcattttaaacttctttttcacaatagtaggaagttacattaaaaacaaacatcctatagatgagaacatatgatttctaaggttttctttcaaacaatatgagagggggaaaaagaagatgaacctggatgaagcaaaattatgctaaagctgggcaaagggtacacagaggttcattataggtactattctgtctgctgttgtacacttggaaaagtttccatcatgattttaaaatgcaaatattataaaggctgagttgatgtaaatgtttatattactaataatacttaggagg

SEQ ID NO: 334820 - DNA, 137 bp, Homo sapiens
gcctctcagtgtgctaagattataggcatgagccaccgcacctgacccacatttctttataatagtgaatttctttataattgtgaattccagtatgctttggcgaaaagggttttttttttttgtttttttttttt

SEQ ID NO: 334821 - DNA, 277 bp, Homo sapiens
gtgagggagaggcggagaaaagctcctgccaaagtcccagagggttaggggacagcattaaatgccctaccctcccaaccagggcaaaggctacagagaagacggttgagggcccaaaggcttcctaatttactatccgcatccccgacaagcatgtacagtcgatcctcatcattcacggattctgcatttgcgaattcgtccacttgctaacatttatctgtagccccaaagctggcactcaccgtgctttggctcattcatggacacacacaca

SEQ ID NO: 334822 - DNA, 407 bp, Homo sapiens
tcctcccagcttctgccagagtagtacaaggactttagaactctttacctcatatctttccctcctgctatttctttctattattttagctctaccttgttttcacttaactgctccacactctaccccaactttatatattttagttcctttacagtcagggcttatttggattgacgtatatgattttgcttttttgcatatactccttattttggtatatcttttagtgattctttcagcaactatctgtgaatggcaatttttttcacttgttgcctgaaaatgtctttattttgccctcattttaaaaaatataatttagcttgataaagaattagaagggttttttttttttttttttggactttgaagatttctccgtggttctctggctttggttattg

SEQ ID NO: 334823 - DNA, 737 bp, Homo sapiens
gaaggagaatcgtttaaacccatgaggcggaggttacagtgagccaagatcgcaccactgcactccagccagggcaacagagcaagactccatctcaaaataaaaaaaaaaaattaacaaaaaggatggtaggagaggtaactccagtactaattggtatgtcttaagcactgctgatgagaaagccattcagatacaaagtactggaaaggcagagggtgtactggaaagtactggaaagggtggttggaggagaatcttttgtgtggtggtgtgcacaagttactggggtaaagtggacaggattacaaggactttagtaggagaaatatgggaggatacattgaggtacttggtaagcatggcttttcgtctcaaggtttacacatataaaagcaaggacaaaaacaaccatagcattgtcttgtatttactacaagtcagaaagttgagtatattgccagtctttttttaaaatagtctggtagttttatgaaaagtctaactaaaactagtactgcttatatattgtccattttgagataaaattgtttacagtgatatgttatacataactagctacatgtcatgtaattataactttactttgaactagggtttttatttatgtggcattgtaacatcaaaaggtcacaataccactaccatctactaaaatgtaagaatatcttttgttaattcctacacggtgtcagctaaaagttcttagtgacaat

SEQ ID NO: 334824 - DNA, 596 bp, Homo sapiens
gccatgtggacagggtctacggacagtacagggccagaggtccctattctgggaccttgacatgctgccgttctcgtgagcttctgggggactcctgcgaggcatgtgggctgcttctcagacctgcgggtaccccacctcccagatgttgtcaatgggatgtgaggttcacgagcacgtcacggagcctctcccctcgtcatgtacgtgcgcatcatggcaaaatgtgcctggccactggttcctgacgctggaaggcacgaacccactccccacacccacagccggcgttgctgtgactgcagtgtctgtgttctaagccccacttttcacatccatccccgctgcccggccagagagacgtcctcagcccagagccccacttttcacatccatccccgctgcccggccagagagacatcctcagcccagagcttcctatctccctcgcctgctcctaccctccagaataaaatgtgtacgaggtagggaatctgtgcttgtctgccagttgtggtcactgctgtatctcttagagtggggcttacccctgggggcccagcgctcagggatgcgtgggctccaggctggagaga

SEQ ID NO: 334825 - DNA, 544 bp, Homo sapiens
cgaagttgtggaggaagtcatcatcgtaacattgtttcaggtatgctggatttgagacgcctgtgcaaaatccaagatgaggatgtcttggttagatctatgcacctagaattcatggaaaagatacagaatcacatctttcatgaagagcaggtcctaaagtcagtgttaggcaacaactgcaaatagcaaaaatcatctttggaaattctaatttaggaagatcccctccaaaggagactcacatactatctcttaataagccagtcgtctagcactagaacaaactaccgtttctttagttgagtcctaaatgatcattaagtagaaaaataagagtattaacttgcatttttaactgtttttaaaaaattctctacccatttgtagttgccacgtatatgtgttgaatttcttaagtgaaaagtacatatgatgtaaataaatcatttacatttaggctttagtgtaaatagatggtaaatgaagtcatggtggataatgagacacagggagagtatattagtttcctatagttgcagta

SEQ ID NO: 334826 - DNA, 311 bp, Homo sapiens
actccgttctgtctgaataaaaaggaatccatgagtttatatggatacaattttttttaatggggaaagaggagaaggaagagaagggaaaactgttctgttacagaagaataacaactaataaacagaaggaataacagaaattataaccaccacagtaataactgattcaggcaagaaccaatggatgccaaatctacctggttaaagattattaacgaatagcatattcacacagttcaaagaataatatcacaggtgacttattaactaccaagggaaaaggacatctttacaatataaaaacctgg

SEQ ID NO: 334827 - DNA, 575 bp, Homo sapiens
tatcctaggatcatatgtagaatcagaggatttcaacgtgctgtataaaaggagagagattctggaacatagggcaaattttagcagagttgggataatgactgggtaagaaaggataattctttgttctaaaagggatttctctggtattaaggccctgtgtgaaagctgctggagaaattcagttctgcaaagtttaaagtaaatggtttgctgtttatggagtactagattacttaatgcagtccagcctttatctaggtaaaggtgatgcttttcccattgtggaagatgttaggatgctaagtttgaatatgaaaatgtgttgtgtgttgtagaggcaatcaaatcaccattttggttgtatttcccattgagaaaattaaagatgcttctgtttgtgtaataattttgtttttatgaaataaagcgtaaaacttcatgtggtaaaatttcacactgtgattcattgtatttgagcatgcctatggaaagtgattgttactgtgtcaaatattgaatgatttgaataattactaagttgttcagttgtgtgtaggatactgctgctttga

SEQ ID NO: 334828 - DNA, 174 bp, Homo sapiens
atctctgttcagcctctgggtctaggtctccctgtgcagcctgtgggtctgggtctctgttcagcctgtgagtctgggtctcttttcagcctgtgggtctaggtctccctgtgcagcctgtgggtctaggtctctgttcagcctgtgggtctgggtctctctgtgcagcctgtg

SEQ ID NO: 334829 - DNA, 247 bp, Homo sapiens
agtggttaatttctccttccccttcttgtcactccctaccctcctgccccatagaccccaaagttatttgtttcgtaaggctataacatcatatttgaatgtatgaccttgaaaaatcctgattaagtagttctgggcaaagctctaatggttggaaaataaatcaggcctcccacacatacctgctcagccaagaatttgtttgccccagaaactgtgggtgggcgggaatggaagcaggcacacg

SEQ ID NO: 334830 - DNA, 356 bp, Homo sapiens
ctgttaagaaattaaggtttcttttaaaaagtgataacttttgaagtactgatttcacagtatcattaaaatcttaccgttgtacaaaacatttgtttaaatcattcaacaatcactatttactatgtaacaggcattgtaatcatagtcactgaaaataccaagtgactgcccagaatggcacagaatccctgttctccagctcatacagtttagctggagagatagacatctaaacaaataattaaatcaatgtgcaaagtgctataacaggagttatgaacaaggcacgatgagtatatagaataagaagagatgaactctgtcaagaaatgttaggatatgatcccagagat

SEQ ID NO: 334831 - DNA, 506 bp, Homo sapiens
ggcccaacttaatggcctcatcttaactaattacatctgcattgactgtgtttcccaataaggtcacattttgaggtactagggcttggacttcaacatatggattttgcaggggggcataattcaacccataatacacaatttagaaaataaaatcatagagcgtggggccagacatggtggctcacgcctgtaatctcaacactttgggaggctgaggtggttggatcacttgaggtcaggagttcgagaacagcctggccaacataatgaaaccccgtctctactaaaaatacaaaaattagctgggcttggtggtgcatgcctgtagtccgaactacttaggagactgaggcaggagaattgcttgaacctgggaggtggaagttgcagtgagccaagatcacgccactgcactccagcctgggcgacagagctagactctgtctcaaaaaaaaaaagtgccaatgtagagtactggagttgtgatccgtagcattggactt

SEQ ID NO: 334832 - DNA, 377 bp, Homo sapiens
tgtctcagagccaaatgtcctccatcttccttctgggagaaatgaggctccctaatgtgcacatacaaagcacactgatttgaaccattacacttaaaagcaaatatgtgggccaactggggtaattttgacttctctacttgagaaagtaaatttaaactttgtgccttaaaatgatattattacaaacaacaaagtattcaaaaacacgagggaaaactgattctggtttgacctcagccgatgtagtacctaggtaaaaacatcaggccaaatcaacctaatcctctattccgggggggggggacttgtttttcctatttttaattagaggattggtttatccaagatacaatgagacacagtcctaggatgaa

SEQ ID NO: 334833 - DNA, 367 bp, Homo sapiens
aggattaggctggatttctagagaacagcaaatggactctgagccaagtcttcacttgcgttccagtacagggacacacagtccccatggaggcacccaaaatggaatcgaagatgttgaagaatatacattgtcacacacacaaacatcctccaggacagaccacaggcgaggccataaaagctccttaataaaatttgagcagaaacacacaagtaagagtagggcacggtggctcacaccattaatcacagcagtttaggaggcccaggtttgaggagtacttgagctcaggggtccgagaccagcctgggcaacatggtgaaacctcatctgtacaaaaaatacaaaagttagcaaggtgtgg

SEQ ID NO: 334834 - DNA, 259 bp, Homo sapiens
catgcccagcccaaaactattgtatttctgtatactgtgacaattggaaatcaaaattttgaaaaatccaaacaaaattacaaagacaaaatatctaaaatgttagtgttatttcatagtagctgagagcagatttaacaccatgaatgtcattgccatttagaaaaattcttttattaatgaaaagaagtttcctaataactatcactgtaatggagaagtcatttgatgtacttcctcatgtcagctcatggttcag

SEQ ID NO: 334835 - DNA, 456 bp, Homo sapiens
actcagtcctcttaacccatctttattttccccatttatgatcaaggctcaccaaaatgaatatttgtctttgatcattacttaggaaaaataacaatactattaagaagaagagaggtaattgacattaggcctcagagacaaggagactgtaggagtgatacaattgaggcaaaggataagagcagcctcaactcagccccagccatttgttatcttgtaggagtgtggtgccggtagggtcagagcttccagcattttctgtgaaatctctcgatttacaaatgttgaaaataattttaaaatgttaaaacacaaagtcaaccattactgtatggtccaaatgaaacagagcaatgggtcagatttggctcatgggtcaccagtgttcaacctctgccgtaatgcagtaggtgcacaatttgtatttttagatattcttgcatactcttttag

SEQ ID NO: 334836 - DNA, 218 bp, Homo sapiens
ctcaagtaatccacctgcctcggcctcccaaagtgctaggattacaggcatgagccacgactcccagccttaatctatttttattgtgcttatcaatgaaccttaattttttttttcaaattctgagaggtcattactgaagatagcctaaactgtaacagaagcctgagaatttttctgtgattccaggcatctggagccattttgcaagaggaatc

SEQ ID NO: 334837 - DNA, 516 bp, Homo sapiens
ccaactatgtggaactgtcatcacagaaaaataattgccctggtcactccccagaaagcttgctcaagattttatccacttttgtttcaccaaagatttgatcttggggaaaaatatatccaactcagccagcttttgaaataacccaggatattgtcatcatgcatattttagaaacacttcaaacttaagagtacgctccatctctttccataagtctccccatgccaaacacacagaccagtccatagacttgagattatagctctttccagaagacaatatgcatatgtatgtatatatctgtcttagcccatctggtctactataacaaagtaccatagactgagtgccttaaacaacaaacatttacttctcacagttctggaggctggaagtccaagatcaagggaactctctggagtctctcttttgagggcattaatcccatttattaggattctatcttcatggcctcaaaagagagtctccgtcgactgggatcctcgtcacccg

SEQ ID NO: 334838 - DNA, 206 bp, Homo sapiens
taagtaactagttatttaattaaaagtaataaaatttagttactaaacacacaaataggcataatttagactaaaggatggctctttaaatgaaatgcgcttagctatataaaatatttacatcagtgtcctattttttttttcatctcactaagaactaggaaaactttgctgtgaaatgaattttgtgaactattactactgga

SEQ ID NO: 334839 - DNA, 305 bp, Homo sapiens
ctgtgaacctcagtatgtttcaaccccagagcactggaaggataggccacatttttgcaagtagcagagtattggcttaggaaagcatgtgtagatttaaattcctcctacaaactgccttccaaaaagattacaatacattcctccttcaaggaaagaacacttgctgatagggaggcattgaaggattttaagaattgtctggtgtgatttgtgctttaaatccctccaggagctgtgtaaaggatgcatttgaaggggtcaagatccaacgtgggtagaacagttaggagagagagcaacag

SEQ ID NO: 334840 - DNA, 725 bp, Homo sapiens
ttcaccagatcccagaggctgaacagctcgaccttctctgcacagcaggtccagcatcctttgaaacatgagttcttaccagcagaagcagacctttaccccaccacctcagcttcaacagcagcaggtgaaacaacccagccagcctccacctcaggaaatatttgttcccacaaccaaggagccatgccactcaaaggttccacaacctggaaacacaaagattccagagccaggctgtaccaaggtccctgagccaggctgtaccaaggtccctgagccaggttgtaccaaggtccctgagccaggatgtaccaaggtccctgagccaggttgtaccaaggtccctgagccaggctacaccaaggtccctgagccaggcagcatcaaggtccctgaccaaggcttcatcaagtttcctgagccaggtgccatcaaagttcctgagcaaggatacaccaaagttcctgtgccaggctacacaaaggtaccagagccatgtccttcaacggtcactccaggcccagctcagcagaagaccaagcagaagtaatttggtgcacagacaagcccttgagaagccaaccaccagatgctggacaccctcttcccatctgtttctgtgtcttaattgtctgtagaccttgtaatcagtatttcggaaaaacaaatctcaaaacaggctgtaagactagggtacacgagtatcgattcgtatctgccat

SEQ ID NO: 334841 - DNA, 1039 bp, Homo sapiens
ttcaccagatcccagaggctgaacagctcgaccttctctgcacagcagatgatccctgagcagctgaagaccagaaaagccactaagactttctgcttaattcaggagcttagaggattcttcaaagagtgtgtccagcatcctttgaaacatgagttcttaccagcagaagcagacctttaccccaccacctcagcttcaacagcagcaggtgaaacaacccagccagcctccacctcaggaaatatttgttcccacaaccaaggagccatgccactcaaaggttccacaacctggaaacacaaagattccagagccaggctgtaccaaggtccctgagccaggctgtaccaaggtccctgagccaggctgtaccaaggtccctgagccaggttgtaccaaggtccctgagccaggatgtaccaaggtccctgagccaggttgtaccaaggtccctgagccaggctacaccaaggtccctgagccaggcagcatcaaggtccctgaccaaggcttcatcaagtttcctgagccaggtgccatcaaagttcctgagcaaggatacaccaaagttcctgtgccaggctacacaaaggtaccagagccatgtccttcaacggtcactccaggcccagctcagcagaagaccaagcagaagtaatttggtgcacagacaagcccttgagaagccaaccaccagatgctggacaccctcttcccatctgtttctgtgtcttaattgtctgtagaccttgtaatcagtacattctcaccccaagccatagtctctctcttatttgtatcctaaaaatacgtactataaagcttttgttcacacacactctgaagaatcctgtaagcccctgaattaagcagaaagtcttcatggcttttctggtcttcggctgctcagggttcatctgaagattcgaatgaaaagaaatgcatgtttcctgctctgccctcattaaattgcttttaattccaaaaaaaaaaagtcgacgcggccgcgaatttagtagtagtagtaggcggccgc

SEQ ID NO: 334842 - DNA, 1015 bp, Homo sapiens
ttcaccagatcccagaggctgaacagctcgaccttctctgcacagcagatgatccctgagcagctgaagaccagaaaagccactaagactttctgcttaattcaggagcttagaggattcttcaaagagtgtgtccagcatcctttgaaacatgagttcttaccagcagaagcagacctttaccccaccacctcagcttcaacagcagcaggtgaaacaacccagccagcctccacctcaggaaatatttgttcccacaaccaaggagccatgccactcaaaggttccacaacctggaaacacaaagattccagagccaggctgtaccaaggtccctgagccaggctgtaccaaggtccctgagccaggttgtaccaaggtccctgagccaggatgtaccaaggtccctgagccaggttgtaccaaggtccctgagccaggctacaccaaggtccctgagccaggcagcatcaaggtccctgaccaaggcttcatcaagtttcctgagccaggtgccatcaaagttcctgagcaaggatacaccaaagttcctgtgccaggctacacaaaggtaccagagccatgtccttcaacggtcactccaggcccagctcagcagaagaccaagcagaagtaatttggtgcacagacaagcccttgagaagccaaccaccagatgctggacaccctcttcccatctgtttctgtgtcttaattgtctgtagaccttgtaatcagtacattctcaccccaagccatagtctctctcttatttgtatcctaaaaatacgtactataaagcttttgttcacacacactctgaagaatcctgtaagcccctgaattaagcagaaagtcttcatggcttttctggtcttcggctgctcagggttcatctgaagattcgaatgaaaagaaatgcatgtttcctgctctgccctcattaaattgcttttaattccaaaaaaaaaaagtcgacgcggccgcgaatttagtagtagtagtaggcggccgc

SEQ ID NO: 334843 - DNA, 873 bp, Homo sapiens
ttcaccagatcccagaggctgaacagctcgaccttctctgcacagcaggtccagcatcctttgaaacatgagttcttaccagcagaagcagacctttaccccaccacctcagcttcaacagcagcaggtgaaacaacccagccagcctccacctcaggaaatatttgttcccacaaccaaggagccatgccactcaaaggttccacaacctggaaacacaaagattccagagccaggctgtaccaaggtccctgagccaggctgtaccaaggtccctgagccaggttgtaccaaggtccctgagccaggatgtaccaaggtccctgagccaggttgtaccaaggtccctgagccaggctacaccaaggtccctgagccaggcagcatcaaggtccctgaccaaggcttcatcaagtttcctgagccaggtgccatcaaagttcctgagcaaggatacaccaaagttcctgtgccaggctacacaaaggtaccagagccatgtccttcaacggtcactccaggcccagctcagcagaagaccaagcagaagtaatttggtgcacagacaagcccttgagaagccaaccaccagatgctggacaccctcttcccatctgtttctgtgtcttaattgtctgtagaccttgtaatcagtacattctcaccccaagccatagtctctctcttatttgtatcctaaaaatacgtactataaagcttttgttcacacacactctgaagaatcctgtaagcccctgaattaagcagaaagtcttcatggcttttctggtcttcggctgctcagggttcatctgaagattcgaatgaaaagaaatgcatgtttcctgatatgccattcttgctgggggatcc

SEQ ID NO: 334844 - DNA, 444 bp, Homo sapiens
agaagtggagattacctgatatgccattcttgctgcagcaagaatggcatatccaagcagaagtaatttggtgcacagacaagcccttgagaagccaaccaccagatgctggacaccctcttcccatctgtttctgtgtcttaattgtctgtagaccttgtaatcagtacattctcaccccaagccatagtctctctcttatttgtatcctaaaaatacgtactataaagcttttgttcacacacactctgaagaatcctgtaagcccctgaattaagcagaaagtcttcatggcttttctggtcttcggctgctcagggttcatctgaagattcgaatgaaaagaaatgcatgtttcctgctctgccctcattaaattgcttttaattccaaaaaaaaaaagtcgacgcggccgcgaatttagtagtagtagtaggcggccgc

SEQ ID NO: 334845 - DNA, 539 bp, Homo sapiens
tcgctgtaccaaagcttcagttatgtttcctgtgtcaggttccatcgcactacttcatcatgtatctccctagcgttcctctgtgatgattattgtcctcagagccatgtccttcaacggtcactccaggcccagctcagcagaagaccaagcagaagtaatttggtgcacagacaagcccttgagaagccaaccaccagatgctggacaccctcttcccatctgtttctgtgtcttaattgtctgtagaccttgtaatcagtacattctcaccccaagccatagtctctctcttatttgtatcctaaaaatacgtactataaagcttttgttcacacacactctgaagaatcctgtaagcccctgaattaagcagaaagtcttcatggcttttctggtcttcggctgctcagggttcatctgaagattcgaatgaaaagaaatgcatgtttcctgctctgccctcattaaattgcttttaattccaaaaaaaaaaagtcgacgcggccgcgaatttagtagtagtagtaggcggccgc

SEQ ID NO: 334846 - DNA, 460 bp, Homo sapiens
ttcaccagatcccagaggctgaacagctcgaccttctctgcacagcagatgatccctgagcagctgaagaccagaaaagccactaagactttctgcttaattcaggagcttagaggattcttcaaagagtgtgtccagcatcctttgaaacatgagttcttaccagcagaagcagacctttaccccaccacctcagcttcaacagcagcaggtgaaacaacccagccagcctccacctcaggaaatatttgttcccacaaccaaggagccatgccactcaaaggttccacaacctggaaacacaaagttaaccatacctacgcacatcatagtctaactgctgataaaccaaagataaagaaaacaatcgtgaaagcagctggagtaagtacacatgaggacttataggtatgtaagttacagttgacttgtcattattatgctgagtcaattcgctctg

SEQ ID NO: 334847 - DNA, 931 bp, Homo sapiens
ttcaccagatcccagaggctgaacagctcgaccttctctgcacagcaggtccagcatcctttgaaacatgagttcttaccagcagaagcagacctttaccccaccacctcagcttcaacagcagcaggtgaaacaacccagccagcctccacctcaggaaatatttgttcccacaaccaaggagccatgccactcaaaggttccacaacctggaaacacaaagattccagagccaggctgtaccaaggtccctgagccaggctgtaccaaggtccctgagccaggttgtaccaaggtccctgagccaggatgtaccaaggtccctgagccaggttgtaccaaggtccctgagccaggctacaccaaggtccctgagccaggcagcatcaaggtccctgaccaaggcttcatcaagtttcctgagccaggtgccatcaaagttcctgagcaaggatacaccaaagttcctgtgccaggctacacaaaggtaccagagccatgtccttcaacggtcactccaggcccagctcagcagaagaccaagcagaagtaatttggtgcacagacaagcccttgagaagccaaccaccagatgctggacaccctcttcccatctgtttctgtgtcttaattgtctgtagaccttgtaatcagtacattctcaccccaagccatagtctctctcttatttgtatcctaaaaatacgtactataaagcttttgttcacacacactctgaagaatcctgtaagcccctgaattaagcagaaagtcttcatggcttttctggtcttcggctgctcagggttcatctgaagattcgaatgaaaagaaatgcatgtttcctgctctgccctcattaaattgcttttaattccaaaaaaaaaaagtcgacgcggccgcgaatttagtagtagtagtaggcggccgc

SEQ ID NO: 334848 - DNA, 995 bp, Homo sapiens
aagaaaagagaggctctcagttctgaaggagaatgaaatgacagatatttgtcattaaactgggcttcattcctacttaatcaaagcactgaattagctgttttgtctctaggtccagcatcctttgaaacatgagttcttaccagcagaagcagacctttaccccaccacctcagcttcaacagcagcaggtgaaacaacccagccagcctccacctcaggaaatatttgttcccacaaccaaggagccatgccactcaaaggttccacaacctggaaacacaaagattccagagccaggctgtaccaaggtccctgagccaggctgtaccaaggtccctgagccaggttgtaccaaggtccctgagccaggatgtaccaaggtccctgagccaggttgtaccaaggtccctgagccaggctacaccaaggtccctgagccaggcagcatcaaggtccctgaccaaggcttcatcaagtttcctgagccaggtgccatcaaagttcctgagcaaggatacaccaaagttcctgtgccaggctacacaaaggtaccagagccatgtccttcaacggtcactccaggcccagctcagcagaagaccaagcagaagtaatttggtgcacagacaagcccttgagaagccaaccaccagatgctggacaccctcttcccatctgtttctgtgtcttaattgtctgtagaccttgtaatcagtacattctcaccccaagccatagtctctctcttatttgtatcctaaaaatacgtactataaagcttttgttcacacacactctgaagaatcctgtaagcccctgaattaagcagaaagtcttcatggcttttctggtcttcggctgctcagggttcatctgaagattcgaatgaaaagaaatgcatgtttcctgctctgccctcattaaattgcttttaattccaaaaaaaaaaagtcgacgcggccgcgaatttagtagtagtagtaggcggccgc

SEQ ID NO: 334849 - DNA, 544 bp, Homo sapiens
atcggcgtcgttaactcaggaatcagctttgactgtgcgtcgtgctcacatgggcgtgatgcaacaatcaggaaagttccttttaccgggctacgtgatacacccagagccatgtccttcaacggtcactccaggcccagctcagcagaagaccaagcagaagtaatttggtgcacagacaagcccttgagaagccaaccaccagatgctggacaccctcttcccatctgtttctgtgtcttaattgtctgtagaccttgtaatcagtacattctcaccccaagccatagtctctctcttatttgtatcctaaaaatacgtactataaagcttttgttcacacacactctgaagaatcctgtaagcccctgaattaagcagaaagtcttcatggcttttctggtcttcggctgctcagggttcatctgaagattcgaatgaaaagaaatgcatgtttcctgctctgccctcattaaattgcttttaattccaaaaaaaaaaagtcgacgcggccgcgaatttagtagtagtagtaggcggccgc

SEQ ID NO: 334850 - DNA, 278 bp, Homo sapiens
aaaaaaaaatacaagaaagaacggcaactaaagaaactggtaaatctaaaaaagtattaactatataaaataataatagtggctcatgtgaaaagtataaaaatagagtgaaaatatattcctgggaaacataaaagatgcaaggggaggtatgaaaattaaagccttcttaggattctctgtgcgtgaggaagttagagatgccaagccaagaatgcactttgaaacgttaaagggtagccactaaaataatggaaatataatgtacacctagggtg

SEQ ID NO: 334851 - DNA, 90 bp, Homo sapiens
cttgtaattttttgttgaaacctgcacaatttgaagatgataatgtggttactttgaaaatcagatcctccgccctctgcagggttcatt

SEQ ID NO: 334852 - DNA, 1324 bp, Homo sapiens
cactcatcaactcttttatgccaacatggtgtttctgcccttgtctcagaagccaactactgatacctgcttcagaaaactgactatgaattccacaaagtcctgcttttttcttttggattgtacaatcaacaaacaagtcacccttctaaaactctgtttctgaaattttaacataattcctgaagttccagagtctcttaaatgctaaaatattaacaataccattccattttttcccctaacactcagaagcatactgatacccatcctgtacacagccttttcttgcctgataacaagagcactaatgacagagctattgcatcaggttgattaataaaccccgtcttaggcagcctcatcatgtggataaagaaaaggagttaagatgatgttcctgctgccttccccaacatagaaacacacccacaacacccccaatcctggaataaccagatgttatcttcatcatcacactagagcactgtaaaccacatcaaaacaaaacgaaacaaataacaacttccctggccaccaaaaatagatggcccagccagaaatagtgctgccagaggcagttaaatgagctgcaaggcaggaatgacagttgagctgcagtgatgctggggcctcccaaggattaccggactccaaactagattctccatcactttggtccaatcaacatcagcaggacttggtatttgttcacaattggttcaactcagattatttgctgagcttctggaattcagagagagtgacttatgggctcacctttttctctagattttaaataatcctttctccatttttttctaggagtgaaggcaattttgaaggcatgactacgacctgctctggccacaagagctaagagttgccaggtgttgtggctcaaacactttgagatgccaatcccaacactttgagaggccaaggcaggaggattgcttgaggctaggagcttgaaaccagcctgggcaacacagtgagaccccatctctacaaaaaataaaaaaacaggccaggcgcagtggcacttagggaggccaaggtgggtggatcacctgaggtcaggagttcgagaccagcctgaccaacatggagaaaccccgtctctacaaaaaatacaaagtttgccagtgtggtggcacatgcctgttatcccagctactcaggaggctgaggcaggagaatcgcttgaacccgaaaggcagaggttgcagtgagtggagatcacgccattgcactccagcctgcgcaacaagagtgaaactccatctcaaataaataaataaaataaagttttaaaaagtca

SEQ ID NO: 334853 - DNA, 1026 bp, Homo sapiens
ctgagataatctgaggcatggagagcacattcacagtgtgtctctgtgtgtgtgtgtgtgtgtgtatgtgcgtgtgcgtgcacatgtgtgcctgcgtgttggggataacatactatcgccccacaacacacccacaacacccccaatcctggaataaccagatgttatcttcatcatcacactagagcactgtaaaccacatcaaaacaaaacgaaacaaataacaacttccctggccaccaaaaatagatggcccagccagaaatagtgctgccagaggcagttaaatgagctgcaaggcaggaatgacagttgagctgcagtgatgctggggcctcccaaggattaccggactccaaactagattctccatcactttggtccaatcaacatcagcaggacttggtatttgttcacaattggttcaactcagattatttgctgagcttctggaattcagagagagtgacttatgggctcacctttttctctagattttaaataatcctttctccatttttttctaggagtgaaggcaattttgaaggcatgactacgacctgctctggccacaagagctaagagttgccaggtgttgtggctcaaacactttgagatgccaatcccaacactttgagaggccaaggcaggaggattgcttgaggctaggagcttgaaaccagcctgggcaacacagtgagaccccatctctacaaaaaataaaaaaacaggccaggcgcagtggcacttagggaggccaaggtgggtggatcacctgaggtcaggagttcgagaccagcctgaccaacatggagaaaccccgtctctacaaaaaatacaaagtttgccagtgtggtggcacatgcctgttatcccagctactcaggaggctgaggcaggagaatcgcttgaacccgaaaggcagaggttgcagtgagtggagatcacgccattgcactccagcctgcgcaacaagagtgaaactccatctcaaataaataaataaaataaagttttaaaaagtca

SEQ ID NO: 334854 - DNA, 355 bp, Homo sapiens
caggaaaggattagtgacgtgagatcaaaataaattaaagaacataaaagtaagtgaagatattcaaggcagagagacaagcccaggctaaatgcagaagcagaaatgaaggcgtaagtttggggatgaggaagggatgagagttaagcatggagaggttgccgacgaatagcgaccctggaaccactagactcttagtccagtgctcttcaggaccctggaggaccctctgcaatttggcctgagactccagccagcagctggaaactcctcgtccaggagactgtccaggtgaggagctcagcagtgaggagggcggaccccatcagcccacttgccaacctgcaatgccacc

SEQ ID NO: 334855 - DNA, 795 bp, Homo sapiens
gcgcacacagatgttagggttcgggcgagctatttggagcctgcgcagtcagatccgaggacatgttgacgtcgtccgagagtcttaaaatcctgctgtggccggattccagactcgtgggggaaaggctggatcttaatgcaagtcatgaacttgaatgtgccgatgaggcctggcattcttgtccagagacagagtaaggaagtgttggccacacccttagaaaacagaagggacatggaggcagaagaggagaaccaaataaatgagaagcaagagcctgagaatgctggagaaactggtcaagaagaggatgatggtttgcagaaaatacacacatctgtcactagaactccttcagttgttgaaagccaaaaaagacctttaaaaggagtgacattttctagggaggtaattgttgtggatcttgggaatgaataccctacacctcgaagctatactcgagaacataaagagaggaaatgaagctcaaaaaagggtaagagtgaaagaaaatgtaacgtttgactaacgttgaaagactgagggtacaaaatcatgttgaaacaacaaaacaatggggaattaagcaaataaagatattattttacctttgtgcagaaaggagtgagccatgtgcaaaattctgtaagtaaaatacttagagcttgaatataattttttaaaaattcaaatctgagttcaagaaattgattgtattgcccttaaaactatctactcaaacactgttctggcatgtgaataaagtgatttttgtttgtacaaatacctatt

SEQ ID NO: 334856 - DNA, 1182 bp, Homo sapiens
  misc_feature (327)..(327): n is a, c, g, or t
gcgcacacagatgttagggttcgggcgagctatttggagcctgcgcagtcagatccgaggacatgttgacgtcgtccgagagtcttaaaatcctgctgtggccggattccagactcgtgggggaaaggctggatttcaacagatcacatggatcaaggccttagggaggtggttggggattcacgtatgccctggaccatctggagcccaagttgctgcagatcctgtcaccacaagtgcacaccctctggccaccatagcaaagaagtctgcaggcaggagatggagtctcgctctgttgcctaggctggagtgcagtggcacganctcagctcactgcaacctctgccttcccagttcaagcaattctcctgcctcagcctcccaggtagctgggattacagtttccaaggcaggaaaggtaaagagacaaagaaagtgccttgtacagatgcaaacggaggtgtagactgtgcagctgccaaagtggtgacaagcaatccagaggaccatgaaaggatcttaatgcaagtcatgaacttgaatgtgccgatgaggcctggcattcttgtccagagacagagtaaggaagtgttggccacacccttagaaaacagaagggacatggaggcagaagaggagaaccaaataaatgagaagcaagagcctgagaatgctggagaaactggtcaagaagaggatgatggtttgcagaaaatacacacatctgtcactagaactccttcagttgttgaaagccaaaaaagacctttaaaaggagtgacattttctagggaggtaattgttgtggatcttgggaatgaataccctacacctcgaagctatactcgagaacataaagagaggaaatgaagctcaaaaaagggtaagagtgaaagaaaatgtaacgtttgactaacgttgaaagactgagggtacaaaatcatgttgaaacaacaaaacaatggggaattaagcaaataaagatattattttacctttgtgcagaaaggagtgagccatgtgcaaaattctgtaagtaaaatacttagagcttgaatataattttttaaaaattcaaatctgagttcaagaaattgattgtattgcccttaaaactatctactcaaacactgttctggcatgtgaataaagtgatttttgtttgtacaaatacctatt

SEQ ID NO: 334857 - DNA, 1031 bp, Homo sapiens
  misc_feature (176)..(176): n is a, c, g, or t
gcgcacacagatgttagggttcgggcgagctatttggagcctgcgcagtcagatccgaggacatgttgacgtcgtccgagagtcttaaaatcctgctgtggccggattccagactcgtgggggaaaggctgatggagtctcgctctgttgcctaggctggagtgcagtggcacganctcagctcactgcaacctctgccttcccagttcaagcaattctcctgcctcagcctcccaggtagctgggattacagtttccaaggcaggaaaggtaaagagacaaagaaagtgccttgtacagatgcaaacggaggtgtagactgtgcagctgccaaagtggtgacaagcaatccagaggaccatgaaaggatcttaatgcaagtcatgaacttgaatgtgccgatgaggcctggcattcttgtccagagacagagtaaggaagtgttggccacacccttagaaaacagaagggacatggaggcagaagaggagaaccaaataaatgagaagcaagagcctgagaatgctggagaaactggtcaagaagaggatgatggtttgcagaaaatacacacatctgtcactagaactccttcagttgttgaaagccaaaaaagacctttaaaaggagtgacattttctagggaggtaattgttgtggatcttgggaatgaataccctacacctcgaagctatactcgagaacataaagagaggaaatgaagctcaaaaaagggtaagagtgaaagaaaatgtaacgtttgactaacgttgaaagactgagggtacaaaatcatgttgaaacaacaaaacaatggggaattaagcaaataaagatattattttacctttgtgcagaaaggagtgagccatgtgcaaaattctgtaagtaaaatacttagagcttgaatataattttttaaaaattcaaatctgagttcaagaaattgattgtattgcccttaaaactatctactcaaacactgttctggcatgtgaataaagtgatttttgtttgtacaaatacctatt

SEQ ID NO: 334858 - DNA, 909 bp, Homo sapiens
gcgcacacagatgttagggttcgggcgagctatttggagcctgcgcagtcagatccgaggacatgttgacgtcgtccgagagtcttaaaatcctgctgtggccggattccagactcgtgggggaaaggctgtttccaaggcaggaaaggtaaagagacaaagaaagtgccttgtacagatgcaaacggaggtgtagactgtgcagctgccaaagtggtgacaagcaatccagaggaccatgaaaggatcttaatgcaagtcatgaacttgaatgtgccgatgaggcctggcattcttgtccagagacagagtaaggaagtgttggccacacccttagaaaacagaagggacatggaggcagaagaggagaaccaaataaatgagaagcaagagcctgagaatgctggagaaactggtcaagaagaggatgatggtttgcagaaaatacacacatctgtcactagaactccttcagttgttgaaagccaaaaaagacctttaaaaggagtgacattttctagggaggtaattgttgtggatcttgggaatgaataccctacacctcgaagctatactcgagaacataaagagaggaaatgaagctcaaaaaagggtaagagtgaaagaaaatgtaacgtttgactaacgttgaaagactgagggtacaaaatcatgttgaaacaacaaaacaatggggaattaagcaaataaagatattattttacctttgtgcagaaaggagtgagccatgtgcaaaattctgtaagtaaaatacttagagcttgaatataattttttaaaaattcaaatctgagttcaagaaattgattgtattgcccttaaaactatctactcaaacactgttctggcatgtgaataaagtgatttttgtttgtacaaatacctatt

SEQ ID NO: 334859 - DNA, 575 bp, Homo sapiens
actactacagaagaaaagatttatgaacttggagtgggaggtagtggtgtggaacatcagacaaaaatttgaagaaatattggctgaaaaatttccaaatttgatggaaatgataaatccacagatctaagagtctcaatgaacacagagcacgagaatcataaagaaaactacatcaaggcacgtaacaacaacaacagtgatagagaaacccttagaagcaatgaaacaatgcaacttccgagttatactaacatagttttcttatttatgaatcacgtctgaactaattcttgtaatagtaacatacaatataatagactgcttatattttacttatgtttgcaaaaagatgttctgggtgggttcccacgaaattattacagtggttaattgttaggggtttggaaacggggtggatgtagcatgagggtagaagaaagatttccacagatgcccgaactaggtaaatgtgtaacctgtttaaaaaattcatgtgtcttttttttttattacaaaaggaatatatcggagggaggggaactaaggagtgacgctaatggacatggggtttc

SEQ ID NO: 334860 - DNA, 559 bp, Homo sapiens
cttctgacatttttccctcaacacttcatatctgagttatctatttacatgtctatgtagcattgaatgaataactagaaacataaaataactcagatcagagatatgttactgttatttccaatattcaattactcctttattttaaaaaatgtttaaaagatacttgactaataacattttctggcactgtttcccaattctccagtgagatgtaaatgagctacagcccctagaaagcccatctaagcagtggctcaaatgctttatcttgcacttgacatattaatattgcacaaagaaaatgagctgaattcctaagtgaacagtaggacaaacaggaaatgtcactgtgatcaataccacttttatcatgtctttctggaagcagaagaaaagaaaaagaaagaacttccagaaaataaaatataattctaccaggtcaagtcagaatgagttctatcatatttaatcacattgttttcagtctttatggcctatggtcaagaatatagtgatattcttgtgagaaaccatctagggccaggtgtggtggctc

SEQ ID NO: 334861 - DNA, 1070 bp, Homo sapiens
agcgggctactcgctatccccggcctgttggcttcttccgcgctggagtatccagataggcgacacgccggcgggcggctgaggcgggaatggctgctgtactgcagcgcgtcgagcggctgtccaatcgagtcgtgcgtgtgttgggctgtaacccgggtcccatgaccctccaaggcaccaacacctacctagtggggaccggccccaggagaatcctcattgacactggagaaccagcaattccagaatacatcagctgtttaaagcaggctctaactgaatttaacacagcaatccaggaaattgtagtgactcactggcaccgagatcattctggaggcataggagatatttgtaaaagcatcaataatgacactacctattgcattaaaaaactcccacggaatcctcagagagaagaaattataggaaatggagagcaacaatatgtttatctgaaagatggagatgtgattaagactgagggagccactctaagagttctatatacccctggccacactgatgatcacatggctctactcttagaagaggaaaatgctatcttttctggagattgcatcctaggggaaggaacaacggtatttgaagacctctatgattatatgaactctttaaaagagttattgaaaatcaaagctgatattatatatccaggacatggcccagtaattcataatgctgaagctaaaattcaacaatacatttctcacagaaatattcgagagcagcaaattcttacattatttcgtgagaactttgagaaatcatttacagtaatggagcttgtaaaaattatttacaagaatactcctgagaatttacatgaaatggctaaacataatctcttacttcatttgaaaaaactagaaaaagaaggaaaaatatttagcaacacagatcctgacaagaaatggaaagctcatctttagtttcagattaaagaaagctttgttttattttgctttgagagaatggtatgttttcttaactataggttattttatagagaatataaaagtataaaacattaaaaataaccctag

SEQ ID NO: 334862 - DNA, 492 bp, Homo sapiens
  misc_feature (29)..(29): n is a, c, g, or t
aattataaagtgtgaattaataatatatnttatatgttttatgactagacactacctattgcattaaaaaactcccacggaatcctcagagagaagaaattataggaaatggagagcaacaatatgtttatctgaaagatggagatgtgattaagactgagggagccactctaaggtaagtaaatgtcccttagccagggaaggtgaagagtctgtgtatgtgtgttatagaaaaggatggaaggatcccagcattttgggaggctgagatgggaagatcgtttgagcccaggagttcaagaccagcctgggcaataccaaaaaaaaatttaattagctgagcatggtggcacatgcctataatcctgctattcaggaggctgagatgagatgattgcttgaacctgggaagcagaggctgcagtgagtcaagattgtaccactgcattccagcctgtgcaaccgagtgaaaccctgtctcaaaaaaaaaaa

SEQ ID NO: 334863 - DNA, 1036 bp, Homo sapiens
agcgggctactcgctatccccggcctgttggcttcttccgcgctggagtatccagataggcgacacgccggcgggcggctgaggcgggaatggctgctgtactgcagcgcgtcgagcggctgtccaatcgagtcgtgcgtgtgttgggctgtaacccgggtcccatgaccctccaaggcaccaacacctacctagtggggaccggccccaggagaatcctcattgacactggagaaccagcaattccagaatacatcagctgtttaaagcaggctctaactgaatttaacacagcaatccaggaaattgtagtgactcactggcaccgagatcattctggaggcataggagatatttgtaaaagcatcaataatgacactacctattgcattaaaaaactcccacggaatcctcagagagaagaaattataggaaatggagagcaacaatatgtttatctgaaagatggagatgtgattaagactgagggagccactctaagagttctatatacccctggccacactgatgatcacatggctctactcttagaagaggaaaatgctatcttttctggagattgcatcctaggggaaggaacaacggtatttgaagacctctatgattatatgaactctttaaaagagttattgaaaatcaaagctgatattatatatccaggacatggcccagtaattcataatgctgaagctaaaattcaacaatacatttctcacagaaatattcgagagcagcaaattcttacattatttcgtgagaactttgagaaatcatttacagtaatggagcttgtaaaaattatttacaagaatactcctgagaatttacatgaaatggctaaacataatctcttacttcatttgaaaaaactagaaaaagaaggaaaaatatgtgagtatgcttccaaattttcttctattaccagcatttaaaatatttttacagatgccttagtttcctttgaggaggcgctaggaaggtcagtagcacagggccagtggaccacaagctggaa

SEQ ID NO: 334864 - DNA, 1159 bp, Homo sapiens
agcgggctactcgctatccccggcctgttggcttcttccgcgctggagtatccagataggcgacacgccggcgggcggctgaggcgggaatggctgctgtactgcagcgcgtcgagcggctgtccaatcgagtcgtgcgtgtgttgggctgtaacccgggtcccatgaccctccaaggcaccaacacctacctagtggggaccggccccaggagaatcctcattgacactggagaaccagcaattccagaatacatcagctgtttaaagcaggctctaactgaatttaacacagcaatccaggaaattgtagtgactcactggcaccgagatcattctggaggcataggagatatttgtaaaagcatcaataatgacactacctattgcattaaaaaactcccacggaatcctcagagagaagaaattataggaaatggagagcaacaatatgtttatctgaaagatggagatgtgattaagactgagggagccactctaagagttctatatacccctggccacactgatgatcacatggctctactcttagaagaggaaaatgctatcttttctggagattgcatcctaggggaaggaacaacggtatttgaagacctctatgattatatgaactctttaaaagagttattgaaaatcaaagctgatattatatatccaggacatggcccagtaattcataatgctgaagctaaaattcaacaatacatttctcacagaaatattcgagagcagcaaattcttacattatttcgtgagaactttgagaaatcatttacagtaatggagcttgtaaaaattatttacaaggtaattttcagttttcttatttgtatgtagccacaaatttattagaattatctatttagtagactatagaaatgataaacttatatcccagatcagaagttacgccacttttctagatttgagaccagcagcctaaactttctacagtgctaaaattaaacaaaaactggccttagagaacaaagatagccatttcgagccatcattgaactttatatacttaactatgtaggagaaactgcctaactatgtaggagaaactaccaacagcctgatgattacattttgtaataatttttgcattattctagccatcttgattatcttgt

SEQ ID NO: 334865 - DNA, 992 bp, Homo sapiens
agcgggctactcgctatccccggcctgttggcttcttccgcgctggagtatccagataggcgacacgccggcgggcggctgaggcgggaatggctgctgtactgcagcgcgtcgagcggctgtccaatcgagtcgtgcgtgtgttgggctgtaacccgggtcccatgaccctccaaggcaccaacacctacctagtggggaccggccccaggagaatcctcattgacactggagaaccagcaattccagaatacatcagctgtttaaagcaggctctaactgaatttaacacagcaatccaggaaattgtagtgactcactggcaccgagatcattctggaggcataggagatatttgtaaaagcatcaataatgacactacctattgcattaaaaaactcccacggaatcctcagagagaagaaattataggaaatggagagcaacaatatgtttatctgaaagatggagatgtgattaagactgagggagccactctaagagttctatatacccctggccacactgatgatcacatggctctactcttagaagaggaaaatgctatcttttctggagattgcatcctaggggaaggaacaacggtatttgaagacctctatgattatatgaactctttaaaagagttattgaaaatcaaagctgatattatatatccagaatactcctgagaatttacatgaaatggctaaacataatctcttacttcatttgaaaaaactagaaaaagaaggaaaaatatttagcaacacagatcctgacaagaaatggaaagctcatctttagtttcaaaaggggaaaaacccttcttaaaaacgggaaaaaaaagctcttgttttattttgctttgagagcaatggtatgttcttcttaactataggttgtttttttagtaacttgtctaatattcctctataaaataacctatacgcttaagaaacatatccacttttttcccccccccttcctca

SEQ ID NO: 334866 - DNA, 405 bp, Homo sapiens
taaaaaaaaaggaatttttttcaccttcatttttcttttagaatactcctgagaatttacatgaaatggctaaacataatctcttacttcatttgaaaaaactagaaaaagaaggaaaaatatgtgagtatgcttccaaattttcttctattaccagcatttaaaatatttttacagatgccttagtttcctttgaggaaaaataatacccatcagagttctcccatgaatatcactttaagttggagagacaggcgctaggaaggtcagtagcacagggccagtggaccacaagctggaaccaaaagctcccaggggaattagaatctcagttggaattccaatccttacccaccagaatggcaatcaaagacatgtagcaggaagataacttttcttctccca

SEQ ID NO: 334867 - DNA, 355 bp, Homo sapiens
cgggaatggctgctgtactgcagcgcgtcgagcggctgtccaatcgagtcgtgcgtgtgttgggctgtaacccgggtcccatgaccctccaaggcaccaacacctacctagtggggaccggccccaggtaaacgtccctctccaacctccccaacgttcgcagccggccccggagcccgggctttgactgatcgcggctgcgcgggcagtggagagcgccgcgtcctgtccctagctgggcagccccgcgcctagcagccccgtcgggactgcacgcagacactcggatctcgaagctagctaaaatacgaccaccccaggtgatagctctctaatttagggagaaatggaaaaa

SEQ ID NO: 334868 - DNA, 1560 bp, Homo sapiens
agcgggctactcgctatccccggcctgttggcttcttccgcgctggagtatccagataggcgacacgccggcgggcggctgaggcgggaatggctgctgtactgcagcgcgtcgagcggctgtccaatcgagtcgtgcgtgtgttgggctgtaacccgggtcccatgaccctccaaggcaccaacacctacctagtggggaccggccccaggagaatcctcattgacactggagaaccagcaattccagaatacatcagctgtttaaagcaggctctaactgaatttaacacagcaatccaggaaattgtagtgactcactggcaccgagatcattctggaggcataggagatatttgtaaaagcatcaataatgacactacctattgcattaaaaaactcccacggaatcctcagagagaagaaattataggaaatggagagcaacaatatgtttatctgaaagatggagatgtgattaagactgagggagccactctaagagttctatatacccctggccacactgatgatcacatggctctactcttagaagaggaaaatgctatcttttctggagattgcatcctaggggaaggaacaacggtatttgaagacctctatgattatatgaactctttaaaagagttattgaaaatcaaagctgatattatatatccaggacatggcccagtaattcataatgctgaagctaaaattcaacaatacatttctcacagaaatattcgagagcagcaaattcttacattatttcgtgagaactttgagaaatcatttacagtaatggagcttgtaaaaattatttacaagaatactcctgagaatttacatgaaatggctaaacataatctcttacttcatttgaaaaaactagaaaaagaaggaaaaatatttagcaacacagatcctgacaagaaatggaaagctcatctttagtttcagattaaagaaagctttgttttattttgctttgagagaatggtatgttttcttaactataggttattttatagagaatataaaagtataaaacattaaaaataaccctagatatactttaaaataatgttatatttatgctaaaatatgtaaattacactatacaaccatatgataggttatttctctaaccttgtcttctaacgttttaccaaaaattcataatctaatagtttatcagttttcaatagattaaataaaatgattactttaaaaataataaaatttatctaatttaaagttgatattatttttggccgttagttatctattactagtgatcagttatactgttttctatagctactttatttaacagcacagatttctatgcacctttactctttcctcaacccttgtctctatctgtacataattgctttgtcttgatgtttctatcaactatatcatgactatctattggttccataactctgtatcatgtgtattttcttattctggtataccacaaatgattcatgcaaatgaatttttggtgattgaaaaatattaaattcccaatttaaagtattatatgata

SEQ ID NO: 334869 - DNA, 437 bp, Homo sapiens
agcgggctactcgctatccccggcctgttggcttcttccgcgctggagtatccagataggcgacacgccggcgggcggctgaggcgggaatggctgctgtactgcagcgcgtcgagcggctgtccaatcgagtcgtgcgtgtgttgggctgtaacccgggtcccatgaccctccaaggcaccaacacctacctagtggggaccggccccaggagaatcctcattgacactggagaaccagcaattccagaatacatcagctgtttaaagcaggctctaactgaatttaacacagcaatccaggaaattgtagtgactcactggcaccgagatcattctggaggcataggagatatttgtaaaagcatcaataatgacactacctattgcattaaatatgtttatctggatggagatgtgattgactgagggagccct

SEQ ID NO: 334870 - DNA, 1411 bp, Homo sapiens
agcgggctactcgctatccccggcctgttggcttcttccgcgctggagtatccagataggcgacacgccggcgggcggctgaggcgggaatggctgctgtactgcagcgcgtcgagcggctgtccaatcgagtcgtgcgtgtgttgggctgtaacccgggtcccatgaccctccaaggcaccaacacctacctagtggggaccggccccaggagaatcctcattgacactggagaaccagcaattccagaatacatcagctgtttaaagcaggctctaactgaatttaacacagcaatccaggaaattgtagtgactcactggcaccgagatcattctggaggcataggagatatttgtaaaagcatcaataatgacactacctattgcattaaaaaactcccacggaatcctcagagagaagaaattataggaaatggagagcaacaatatgtttatctgaaagatggagatgtgattaagactgagggagccactctaagagttctatatacccctggccacactgatgatcacatggctctactcttagaagaggaaaatgctatcttttctggagattgcatcctaggggaaggaacaacggtatttgaagacctctatgattatatgaactctttaaaagagttattgaaaatcaaagctgatattatatatccagaatactcctgagaatttacatgaaatggctaaacataatctcttacttcatttgaaaaaactagaaaaagaaggaaaaatatttagcaacacagatcctgacaagaaatggaaagctcatctttagtttcagattaaagaaagctttgttttattttgctttgagagaatggtatgttttcttaactataggttattttatagagaatataaaagtataaaacattaaaaataaccctagatatactttaaaataatgttatatttatgctaaaatatgtaaattacactatacaaccatatgataggttatttctctaaccttgtcttctaacgttttaccaaaaattcataatctaatagtttatcagttttcaatagattaaataaaatgattactttaaaaataataaaatttatctaatttaaagttgatattatttttggccgttagttatctattactagtgatcagttatactgttttctatagctactttatttaacagcacagatttctatgcacctttactctttcctcaacccttgtctctatctgtacataattgctttgtcttgatgtttctatcaactatatcatgactatctattggttccataactctgtatcatgtgtattttcttattctggtataccacaaatgattcatgcaaatgaatttttggtgattgaaaaatattaaattcccaatttaaagtattatatgata

SEQ ID NO: 334871 - DNA, 819 bp, Homo sapiens
agcgggctactcgctatccccggcctgttggcttcttccgcgctggagtatccagataggcgacacgccggcgggcggctgaggcgggaatggctgctgtactgcagcgcgtcgagcggctgtccaatcgagtcgtgcgtgtgttgggctgtaacccgggtcccatgaccctccaaggcaccaacacctacctagtggggaccggccccaggagaatcctcattgacactggagaaccagcaattccagaatacatcagctgtttaaagcaggctctaactgaatttaacacagcaatccaggaaattgtagtgactcactggcaccgagatcattctggaggcataggagatatttgtaaaagcatcaataatgacactacctattgcattaaaaaactcccacggaatcctcagagagaagaaattataggaaatggagagcaacaatatgtttatctgaaagatggagatgtgattaagactgagggagccactctaaggtaagtaaatgtcccttagccagggaaggtgaagagtctgtgtatgtgtgttatagaaaaggatggaaggatcccagcattttgggaggctgagatgggaagatcgtttgagcccaggagttcaagaccagcctgggcaataccaaaaaaaaatttaattagctgagcatggtggcacatgcctataatcctgctattcaggaggctgagatgagatgattgcttgaacctgggaagcagaggctgcagtgagtcaagattgtaccactgcattccagcctgtgcaaccgagtgaaaccctgtctcaaaaaaaaaaa

SEQ ID NO: 334872 - DNA, 387 bp, Homo sapiens
ctctgcctccctgagagctgggattataggcgtgagccaccgcgcccagcctgtttgtttgtttttaactcgttgtagcattacatctaaaagtaatgtggaaattacttgttctccttttgatttttttggcatgaaatacacacttcattctgactttttttggtgttgatgctttcttataatataaatcagcttatagtgccgtttctttacttgtattttttcctctgccttgagtacgttttctctatctgtatacctagtcccattccccactctacccccaactccctgaatctactttgtgaactcatgtttcaaggttcagctcagaagtcacttctttcaagttttctcccgcacccacagcagagttaggagctc

SEQ ID NO: 334873 - DNA, 214 bp, Homo sapiens
  misc_feature (23)..(23): n is a, c, g, or t
  misc_feature (26)..(26): n is a, c, g, or t
  misc_feature (30)..(31): n is a, c, g, or t
  misc_feature (33)..(34): n is a, c, g, or t
tgatctagaggatcccgaggctnctntgtnngnntgtagacatgcaagcccgaggcttcggctcggatcagtccgagaatgtcgaccggggcgcgggctccatccgggaagccggtggggccttcggaaagagagagcaggctgaagaggaacgatatttccgccacagagagagcgtcccccacagagagagcgtcccccacagagagagcgt

SEQ ID NO: 334874 - DNA, 1962 bp, Homo sapiens
taggcggaagggccatgggagtgtgcggaaattctgtgcacggatggggtggcccggtccactgtccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgttccggtgaggctcaccgggtcccaagtccagccctggatctcccaatggccttccaatccttaaactgccaatcgccccacccgttcctacctggtgccttgggcgccccatcccccaacagaactcccgggccccaatccagtataccctaacccttgatgtcccgaccgttgccacgtatagggcactcccagttacctgcacaacagtttcaggcccccaaaccgtttccaccggcgggtctccaaaacaacccacggctcaactcctcctttatcattaccatctcccgcgtggagttctcctcaggtcgtgcgaaacacccccagattcttcgcacagtgtctagatccgaccgcccaacgtttgcctcccagcctgactccctcggcccttacccacctgtcaccccctctacgctctccttcctcgccagcacgccttagctttgcaagcctgcatgcattcaggcttctcaggtgtttctagacccccgactccgcaagagtgaggatgatgggagctggtcatgggagctacttatggttggacaccatcttctaaaggcttttgccctactcagcccaacctagacctgtagatttccctctcctgcttaggagtatggagtgggctgggcctccctttgccagccttgagttatctttaactgacttctgtccactctggagagcagtgaggaattaatcttgcttttgcttgtcctttggcctttcacttctgccttctgttgagaattatcaccatgacacctgccataccgtatagagagccaaggtacagccgttagagactatctaattgagcccctacattttgtagttaaggaaaactgaggcctaaatgtgaccaaaccaacattgtaatccagtcccttcttggaacctaaattgaactgccaagtactgcgcatgcaagagaccctttattggccttacagtgggccattcatttctataggcaaagaaagctctagacagattggaataggaaatggatatttgccttttagctacacccctttgtctgtcttcctcattttgttcctttttttttccctaaaggggagtcaagttccctgggttgttcccctcataaggtattagggacttgtgtcacatctctctggagttttctattttaaagaggaatctgaaagcaataagctctttggtcttcttaagatggctacacctcaatttaagatggggtattctttcactagttgaggagtagaagaggatgaccagctagactcccatggaattggaactcctattccttgcttagacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaa

SEQ ID NO: 334875 - DNA, 2099 bp, Homo sapiens
  misc_feature (2099)..(2099): n is a, c, g, or t
cccctccgtcgaccagattgggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgttccggtgaggctcaccgggtcccaagtccagccctggatctcccaatggccttccaatccttaaactgccaatcgccccacccgttcctacctggtgccttgggcgccccatcccccaacagaactcccgggccccaatccagtataccctaacccttgatgtcccgaccgttgccacgtatagggcactcccagttacctgcacaacagtttcaggcccccaaaccgtttccaccggcgggtctccaaaacaacccacggctcaactcctcctttatcattaccatctcccgcgtggagttctcctcaggtcgtgcgaaacacccccagattcttcgcacagtgtctagatccgaccgcccaacgtttgcctcccagcctgactccctcggcccttacccacctgtcaccccctctacgctctccttcctcgccagcacgccttagctttgcaagcctgcatgcattcaggcttctcaggtgtttctagacccccgactccgcaagagtgaggatgatgggagctggtcatgggagctacttatggttggacaccatcttctaaaggcttttgccctactcagcccaacctagacctgtagatttccctctcctgcttaggagtatggagtgggctgggcctccctttgccagccttgagttatctttaactgacttctgtccactctggagagcagtgaggaattaatcttgcttttgcttgtcctttggcctttcacttctgccttctgttgagaattatcaccatgacacctgccataccgtatagagagccaaggtacagccgttagagactatctaattgagcccctacattttgtagttaaggaaaactgaggcctaaatgtgaccaaaccaacattgtaatccagtcccttcttggaacctaaattgaactgccaagtactgcgcatgcaagagaccctttattggccttacagtgggccattcatttctataggcaaagaaagctctagacagattggaataggaaatggatatttgccttttagctacacccctttgtctgtcttcctcattttgttcctttttttttccctaaaggggagtcaagttccctgggttgttcccctcataaggtattagggacttgtgtcacatctctctggagttttctattttaaagaggaatctgaaagcaataagctctttggtcttcttaagatggctacacctcaatttaagatggggtattctttcactagttgaggagtagaagaggatgaccagctagactcccatggaattggaactcctattccttgcttagacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaaaaaaaaaagggaaactcaggtggtccaccccgagacccctttgagcaccaacctagtcccccgcgcggccccttattcgctccgacaagatgaaagaaacaatcatgaaccaggaaaaactcgccaaactgcaggcacaagtgcgcattgggtgggaaaggaan

SEQ ID NO: 334876 - DNA, 872 bp, Homo sapiens
  misc_feature (47)..(47): n is a, c, g, or t
  misc_feature (60)..(60): n is a, c, g, or t
  misc_feature (74)..(74): n is a, c, g, or t
cccctatccaatctaacccgatccatactactaatctatactgaccnatctatactaccnatctatactgaccnatctatactgaccggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaaaaaaaaaaaaaaaaaaaaaaaaaaaaaaaaaaaaaaaaaaaaaaaacaaaacaaacaaacaaaaacaaacaaaacaaaaaaaaaaaaaaaaaagcaacaacaaaagcaaaacacacaacacaaacaaaaaaagaaggatgggcttcgccgacagaaaacacaataaaatcaagtcgcatggcggggcgcagagacaaaatataacgagatggacaacatgaggaagaaacagtgctgtagggatgcgacaaaccaaacg

SEQ ID NO: 334877 - DNA, 1970 bp, Homo sapiens
  misc_feature (47)..(47): n is a, c, g, or t
  misc_feature (60)..(60): n is a, c, g, or t
  misc_feature (74)..(74): n is a, c, g, or t
cccctatccaatctaacccgatccatactactaatctatactgaccnatctatactaccnatctatactgaccnatctatactgaccggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgccctggatctcccaatggccttccaatccttaaactgccaatcgccccacccgttcctacctggtgccttgggcgccccatcccccaacagaactcccgggccccaatccagtataccctaacccttgatgtcccgaccgttgccacgtatagggcactcccagttacctgcacaacagtttcaggcccccaaaccgtttccaccggcgggtctccaaaacaacccacggctcaactcctcctttatcattaccatctcccgcgtggagttctcctcaggtcgtgcgaaacacccccagattcttcgcacagtgtctagatccgaccgcccaacgtttgcctcccagcctgactccctcggcccttacccacctgtcaccccctctacgctctccttcctcgccagcacgccttagctttgcaagcctgcatgcattcaggcttctcaggtgtttctagacccccgactccgcaagagtgaggatgatgggagctggtcatgggagctacttatggttggacaccatcttctaaaggcttttgccctactcagcccaacctagacctgtagatttccctctcctgcttaggagtatggagtgggctgggcctccctttgccagccttgagttatctttaactgacttctgtccactctggagagcagtgaggaattaatcttgcttttgcttgtcctttggcctttcacttctgccttctgttgagaattatcaccatgacacctgccataccgtatagagagccaaggtacagccgttagagactatctaattgagcccctacattttgtagttaaggaaaactgaggcctaaatgtgaccaaaccaacattgtaatccagtcccttcttggaacctaaattgaactgccaagtactgcgcatgcaagagaccctttattggccttacagtgggccattcatttctataggcaaagaaagctctagacagattggaataggaaatggatatttgccttttagctacacccctttgtctgtcttcctcattttgttcctttttttttccctaaaggggagtcaagttccctgggttgttcccctcataaggtattagggacttgtgtcacatctctctggagttttctattttaaagaggaatctgaaagcaataagctctttggtcttcttaagatggctacacctcaatttaagatggggtattctttcactagttgaggagtagaagaggatgaccagctagactcccatggaattggaactcctattccttgcttagacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaa

SEQ ID NO: 334878 - DNA, 2092 bp, Homo sapiens
  misc_feature (47)..(47): n is a, c, g, or t
  misc_feature (60)..(60): n is a, c, g, or t
  misc_feature (74)..(74): n is a, c, g, or t
cccctatccaatctaacccgatccatactactaatctatactgaccnatctatactaccnatctatactgaccnatctatactgaccggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcaggtacgctgcggcagtgtccgctgctccagccccgcgggcggatcccatctttgcttccgtacctttaccagtgtccctgtctctctgcagtccgagaatgtcgaccggggcgcgggctccatccgggaagccggtggggccttcggaaagagagagcaggctgaagaggaacgatatttccgttccggtgaggctcaccgggtcccaagtccagccctggatctcccaatggccttccaatccttaaactgccaatcgccccacccgttcctacctggtgccttgggcgccccatcccccaacagaactcccgggccccaatccagtataccctaacccttgatgtcccgaccgttgccacgtatagggcactcccagttacctgcacaacagtttcaggcccccaaaccgtttccaccggcgggtctccaaaacaacccacggctcaactcctcctttatcattaccatctcccgcgtggagttctcctcaggtcgtgcgaaacacccccagattcttcgcacagtgtctagatccgaccgcccaacgtttgcctcccagcctgactccctcggcccttacccacctgtcaccccctctacgctctccttcctcgccagcacgccttagctttgcaagcctgcatgcattcaggcttctcaggtgtttctagacccccgactccgcaagagtgaggatgatgggagctggtcatgggagctacttatggttggacaccatcttctaaaggcttttgccctactcagcccaacctagacctgtagatttccctctcctgcttaggagtatggagtgggctgggcctccctttgccagccttgagttatctttaactgacttctgtccactctggagagcagtgaggaattaatcttgcttttgcttgtcctttggcctttcacttctgccttctgttgagaattatcaccatgacacctgccataccgtatagagagccaaggtacagccgttagagactatctaattgagcccctacattttgtagttaaggaaaactgaggcctaaatgtgaccaaaccaacattgtaatccagtcccttcttggaacctaaattgaactgccaagtactgcgcatgcaagagaccctttattggccttacagtgggccattcatttctataggcaaagaaagctctagacagattggaataggaaatggatatttgccttttagctacacccctttgtctgtcttcctcattttgttcctttttttttccctaaaggggagtcaagttccctgggttgttcccctcataaggtattagggacttgtgtcacatctctctggagttttctattttaaagaggaatctgaaagcaataagctctttggtcttcttaagatggctacacctcaatttaagatggggtattctttcactagttgaggagtagaagaggatgaccagctagactcccatggaattggaactcctattccttgcttagacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaa

SEQ ID NO: 334879 - DNA, 1759 bp, Homo sapiens
catggtcagttcgagcttcgagagagggcagcgtggttcccatgccagcatggggggccgggacgacagtcctggcgcagggtggttataaacatgggaggctctcatctcctcgggggcagagatggacacggtcacgcagcaccaatagtgtgtctggcttgtccagttggtgtgcatttgaggtgggaacgccattcggggcagaggccatagagatgggctgtttaactcccgggccccaatccagtataccctaacccttgatgtcccgaccgttgccacgtatagggcactcccagttacctgcacaacagtttcaggcccccaaaccgtttccaccggcgggtctccaaaacaacccacggctcaactcctcctttatcattaccatctcccgcgtggagttctcctcaggtcgtgcgaaacacccccagattcttcgcacagtgtctagatccgaccgcccaacgtttgcctcccagcctgactccctcggcccttacccacctgtcaccccctctacgctctccttcctcgccagcacgccttagctttgcaagcctgcatgcattcaggcttctcaggtgtttctagacccccgactccgcaagagtgaggatgatgggagctggtcatgggagctacttatggttggacaccatcttctaaaggcttttgccctactcagcccaacctagacctgtagatttccctctcctgcttaggagtatggagtgggctgggcctccctttgccagccttgagttatctttaactgacttctgtccactctggagagcagtgaggaattaatcttgcttttgcttgtcctttggcctttcacttctgccttctgttgagaattatcaccatgacacctgccataccgtatagagagccaaggtacagccgttagagactatctaattgagcccctacattttgtagttaaggaaaactgaggcctaaatgtgaccaaaccaacattgtaatccagtcccttcttggaacctaaattgaactgccaagtactgcgcatgcaagagaccctttattggccttacagtgggccattcatttctataggcaaagaaagctctagacagattggaataggaaatggatatttgccttttagctacacccctttgtctgtcttcctcattttgttcctttttttttccctaaaggggagtcaagttccctgggttgttcccctcataaggtattagggacttgtgtcacatctctctggagttttctattttaaagaggaatctgaaagcaataagctctttggtcttcttaagatggctacacctcaatttaagatggggtattctttcactagttgaggagtagaagaggatgaccagctagactcccatggaattggaactcctattccttgcttagacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaa

SEQ ID NO: 334880 - DNA, 689 bp, Homo sapiens
  misc_feature (47)..(47): n is a, c, g, or t
  misc_feature (60)..(60): n is a, c, g, or t
  misc_feature (74)..(74): n is a, c, g, or t
cccctatccaatctaacccgatccatactactaatctatactgaccnatctatactaccnatctatactgaccnatctatactgaccggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaa

SEQ ID NO: 334881 - DNA, 826 bp, Homo sapiens
  misc_feature (47)..(47): n is a, c, g, or t
  misc_feature (60)..(60): n is a, c, g, or t
  misc_feature (74)..(74): n is a, c, g, or t
cccctatccaatctaacccgatccatactactaatctatactgaccnatctatactaccnatctatactgaccnatctatactgaccggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaaaaaaaaaaaaaaaaaaaaaaaattcgggggcatctaaggcgggggggggaaaaaggggtttggaagtgggcctgggccaaaagtggtttcctggaccaagtttttttggccccagtggggaaattggcgggtcccta

SEQ ID NO: 334882 - DNA, 663 bp, Homo sapiens
  misc_feature (47)..(47): n is a, c, g, or t
  misc_feature (60)..(60): n is a, c, g, or t
  misc_feature (74)..(74): n is a, c, g, or t
cccctatccaatctaacccgatccatactactaatctatactgaccnatctatactaccnatctatactgaccnatctatactgaccggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgagcacttggagctaccttctgtttctttgctgtagaagccgttgtgtgaacaaatccgtttatttctctcatcagtctcctttgatagacatttgggtcacgtccggttttacgcttttacaatacatcagtgaacagcagtaatacgagctcaagacagaaggcctgaaaaacattgaaaaacacagagacggaaaaaaaaaaaccacagagggggaaatataatttcgggttatttcagtttcacctttacactttgttatattccacattttttgcaataaatataaatttggaagtaaaagcataaaacg

SEQ ID NO: 334883 - DNA, 847 bp, Homo sapiens
  misc_feature (47)..(47): n is a, c, g, or t
  misc_feature (60)..(60): n is a, c, g, or t
  misc_feature (74)..(74): n is a, c, g, or t
  misc_feature (824)..(824): n is a, c, g, or t
cccctatccaatctaacccgatccatactactaatctatactgaccnatctatactaccnatctatactgaccnatctatactgaccggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgagcacttggagctaccttctgtttctttgctgtagaagccgttgtgtgaacaaatccgtttatttctctcatcagtctcctttgatagacatttgggtcacgtccggttttacgcttttacaatacatcagtgaacagcagtaatacgagctcaagacagaaggcctgaaaaacattgaaaaacacagagacggaaaaaaaaaaaccacagagggggaaatataatttcgggttatttcagtttcacctttacactttgttatattccacattttttgcaataaatataaatttggaagtaaaagcataaaacgaaaatcaaacgattgattgattgattgattgactgagacggagtatcactctcgtcgtccaggctggagtgtagtggcgcgttctcggctcactgcaacagttagtggggcgtggtggcatgctcctgtagtctcagctactctggagctgagtctgtatnactgcttggggatcctcagacgc

SEQ ID NO: 334884 - DNA, 1944 bp, Homo sapiens
ggcacgaggctgcggctgggcctcaatgaccgcgtgctcttcgagctcactggccgcagctctggcattcctgacagaaacaccttgagcttgatggtaccctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgttccggtgaggctcaccgggtcccaagtccagccctggatctcccaatggccttccaatccttaaactgccaatcgccccacccgttcctacctggtgccttgggcgccccatcccccaacagaactcccgggccccaatccagtataccctaacccttgatgtcccgaccgttgccacgtatagggcactcccagttacctgcacaacagtttcaggcccccaaaccgtttccaccggcgggtctccaaaacaacccacggctcaactcctcctttatcattaccatctcccgcgtggagttctcctcaggtcgtgcgaaacacccccagattcttcgcacagtgtctagatccgaccgcccaacgtttgcctcccagcctgactccctcggcccttacccacctgtcaccccctctacgctctccttcctcgccagcacgccttagctttgcaagcctgcatgcattcaggcttctcaggtgtttctagacccccgactccgcaagagtgaggatgatgggagctggtcatgggagctacttatggttggacaccatcttctaaaggcttttgccctactcagcccaacctagacctgtagatttccctctcctgcttaggagtatggagtgggctgggcctccctttgccagccttgagttatctttaactgacttctgtccactctggagagcagtgaggaattaatcttgcttttgcttgtcctttggcctttcacttctgccttctgttgagaattatcaccatgacacctgccataccgtatagagagccaaggtacagccgttagagactatctaattgagcccctacattttgtagttaaggaaaactgaggcctaaatgtgaccaaaccaacattgtaatccagtcccttcttggaacctaaattgaactgccaagtactgcgcatgcaagagaccctttattggccttacagtgggccattcatttctataggcaaagaaagctctagacagattggaataggaaatggatatttgccttttagctacacccctttgtctgtcttcctcattttgttcctttttttttccctaaaggggagtcaagttccctgggttgttcccctcataaggtattagggacttgtgtcacatctctctggagttttctattttaaagaggaatctgaaagcaataagctctttggtcttcttaagatggctacacctcaatttaagatggggtattctttcactagttgaggagtagaagaggatgaccagctagactcccatggaattggaactcctattccttgcttagacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaa

SEQ ID NO: 334885 - DNA, 1935 bp, Homo sapiens
cccctccgtcgaccagattgggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgttccggtgaggctcaccgggtcccaagtccagccctggatctcccaatggccttccaatccttaaactgccaatcgccccacccgttcctacctggtgccttgggcgccccatcccccaacagaactcccgggccccaatccagtataccctaacccttgatgtcccgaccgttgccacgtatagggcactcccagttacctgcacaacagtttcaggcccccaaaccgtttccaccggcgggtctccaaaacaacccacggctcaactcctcctttatcattaccatctcccgcgtggagttctcctcaggtcgtgcgaaacacccccagattcttcgcacagtgtctagatccgaccgcccaacgtttgcctcccagcctgactccctcggcccttacccacctgtcaccccctctacgctctccttcctcgccagcacgccttagctttgcaagcctgcatgcattcaggcttctcaggtgtttctagacccccgactccgcaagagtgaggatgatgggagctggtcatgggagctacttatggttggacaccatcttctaaaggcttttgccctactcagcccaacctagacctgtagatttccctctcctgcttaggagtatggagtgggctgggcctccctttgccagccttgagttatctttaactgacttctgtccactctggagagcagtgaggaattaatcttgcttttgcttgtcctttggcctttcacttctgccttctgttgagaattatcaccatgacacctgccataccgtatagagagccaaggtacagccgttagagactatctaattgagcccctacattttgtagttaaggaaaactgaggcctaaatgtgaccaaaccaacattgtaatccagtcccttcttggaacctaaattgaactgccaagtactgcgcatgcaagagaccctttattggccttacagtgggccattcatttctataggcaaagaaagctctagacagattggaataggaaatggatatttgccttttagctacacccctttgtctgtcttcctcattttgttcctttttttttccctaaaggggagtcaagttccctgggttgttcccctcataaggtattagggacttgtgtcacatctctctggagttttctattttaaagaggaatctgaaagcaataagctctttggtcttcttaagatggctacacctcaatttaagatggggtattctttcactagttgaggagtagaagaggatgaccagctagactcccatggaattggaactcctattccttgcttagacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaa

SEQ ID NO: 334886 - DNA, 613 bp, Homo sapiens
  misc_feature (47)..(47): n is a, c, g, or t
  misc_feature (60)..(60): n is a, c, g, or t
  misc_feature (74)..(74): n is a, c, g, or t
cccctatccaatctaacccgatccatactactaatctatactgaccnatctatactaccnatctatactgaccnatctatactgaccggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaa

SEQ ID NO: 334887 - DNA, 1816 bp, Homo sapiens
  misc_feature (23)..(23): n is a, c, g, or t
  misc_feature (26)..(26): n is a, c, g, or t
  misc_feature (30)..(31): n is a, c, g, or t
  misc_feature (33)..(34): n is a, c, g, or t
tgatctagaggatcccgaggctnctntgtnngnntgtagacatgcaagcccgaggcttcggctcggatcagtccgagaatgtcgaccggggcgcgggctccatccgggaagccggtggggccttcggaaagagagagcaggctgaagaggaacgatatttccgttccggtgaggctcaccgggtcccaagtccagccctggatctcccaatggccttccaatccttaaactgccaatcgccccacccgttcctacctggtgccttgggcgccccatcccccaacagaactcccgggccccaatccagtataccctaacccttgatgtcccgaccgttgccacgtatagggcactcccagttacctgcacaacagtttcaggcccccaaaccgtttccaccggcgggtctccaaaacaacccacggctcaactcctcctttatcattaccatctcccgcgtggagttctcctcaggtcgtgcgaaacacccccagattcttcgcacagtgtctagatccgaccgcccaacgtttgcctcccagcctgactccctcggcccttacccacctgtcaccccctctacgctctccttcctcgccagcacgccttagctttgcaagcctgcatgcattcaggcttctcaggtgtttctagacccccgactccgcaagagtgaggatgatgggagctggtcatgggagctacttatggttggacaccatcttctaaaggcttttgccctactcagcccaacctagacctgtagatttccctctcctgcttaggagtatggagtgggctgggcctccctttgccagccttgagttatctttaactgacttctgtccactctggagagcagtgaggaattaatcttgcttttgcttgtcctttggcctttcacttctgccttctgttgagaattatcaccatgacacctgccataccgtatagagagccaaggtacagccgttagagactatctaattgagcccctacattttgtagttaaggaaaactgaggcctaaatgtgaccaaaccaacattgtaatccagtcccttcttggaacctaaattgaactgccaagtactgcgcatgcaagagaccctttattggccttacagtgggccattcatttctataggcaaagaaagctctagacagattggaataggaaatggatatttgccttttagctacacccctttgtctgtcttcctcattttgttcctttttttttccctaaaggggagtcaagttccctgggttgttcccctcataaggtattagggacttgtgtcacatctctctggagttttctattttaaagaggaatctgaaagcaataagctctttggtcttcttaagatggctacacctcaatttaagatggggtattctttcactagttgaggagtagaagaggatgaccagctagactcccatggaattggaactcctattccttgcttagacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaa

SEQ ID NO: 334888 - DNA, 1830 bp, Homo sapiens
gacctcgattccctatccgtgtccggggttgacgcagcctacgctgatggacaccgggcgcgtgaggttcatgcatgcgagccgctgccgctctgatcagtccgaccctgctgaccgccgcgctgactacatccgagctgccgaggaatccttctgaaagagatagcggattctatattccggtgaggctcaccgggtcccaagtccagccctggatctcccaatggccttccaatccttaaactgccaatcgccccacccgttcctacctggtgccttgggcgccccatcccccaacagaactcccgggccccaatccagtataccctaacccttgatgtcccgaccgttgccacgtatagggcactcccagttacctgcacaacagtttcaggcccccaaaccgtttccaccggcgggtctccaaaacaacccacggctcaactcctcctttatcattaccatctcccgcgtggagttctcctcaggtcgtgcgaaacacccccagattcttcgcacagtgtctagatccgaccgcccaacgtttgcctcccagcctgactccctcggcccttacccacctgtcaccccctctacgctctccttcctcgccagcacgccttagctttgcaagcctgcatgcattcaggcttctcaggtgtttctagacccccgactccgcaagagtgaggatgatgggagctggtcatgggagctacttatggttggacaccatcttctaaaggcttttgccctactcagcccaacctagacctgtagatttccctctcctgcttaggagtatggagtgggctgggcctccctttgccagccttgagttatctttaactgacttctgtccactctggagagcagtgaggaattaatcttgcttttgcttgtcctttggcctttcacttctgccttctgttgagaattatcaccatgacacctgccataccgtatagagagccaaggtacagccgttagagactatctaattgagcccctacattttgtagttaaggaaaactgaggcctaaatgtgaccaaaccaacattgtaatccagtcccttcttggaacctaaattgaactgccaagtactgcgcatgcaagagaccctttattggccttacagtgggccattcatttctataggcaaagaaagctctagacagattggaataggaaatggatatttgccttttagctacacccctttgtctgtcttcctcattttgttcctttttttttccctaaaggggagtcaagttccctgggttgttcccctcataaggtattagggacttgtgtcacatctctctggagttttctattttaaagaggaatctgaaagcaataagctctttggtcttcttaagatggctacacctcaatttaagatggggtattctttcactagttgaggagtagaagaggatgaccagctagactcccatggaattggaactcctattccttgcttagacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaa

SEQ ID NO: 334889 - DNA, 553 bp, Homo sapiens
  misc_feature (47)..(47): n is a, c, g, or t
  misc_feature (60)..(60): n is a, c, g, or t
  misc_feature (74)..(74): n is a, c, g, or t
cccctatccaatctaacccgatccatactactaatctatactgaccnatctatactaccnatctatactgaccnatctatactgaccggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgcgccgacgccgtcgagcgcgccgacg

SEQ ID NO: 334890 - DNA, 718 bp, Homo sapiens
tccttccctctctcacggggatgctgcgaggattaagcaagataattaaagttgaaacatcagttcccattccccagcatggcccacctccctttccagcttcactttctcttagcacttgtcaccttcccagaatagagagccttttgctcgtttttgttgtaaattttccttctcctcatgctgaaatagaggcctcacgtgagtagggagatgaccattctgttcactgttctatcccaagagcctagaacagcgcttggcacacagttggtactctgcaaatatttgctgaatatatgatccacataaagccacttaggagtgcgcttggtatcagtgactaccaggtaaaggtagcaatgacaacagtggtgatgatattgataaaggtgaattctatttgaggcacataaaagccaggttccatgcagatacaattgatcccatttgacagatgaggaaactgagggaggttccaagaggcagagtgacctgccccagccatgatgtcagtggtagaactacaccagactctgctcttctggttggtcatgggatggacttccccaaggctacagaggtggctcttccctgggcagaaggcccctctggggatgacaaacacccagtggagtagccctgagtgggacaagggctttggaacggggtgggcgttgacaggcttggctcctgtggtgacgcccaatgtctcatg

SEQ ID NO: 334891 - DNA, 4625 bp, Homo sapiens
gcgaactggctggaggagctaggggactagaggcggggtgggaggggggcgggtggaagggggaggaagtcccgtaacggagacgctggtcaggacgttcccacctcctctgacactgccgagtccgatcggagaggggtcaccgcctccttcagcgaggaggaggggggcggagcccgactcaggatcatggattttcctggtcactttgaacaaatcttccagcagctgaactaccagagacttcatggccagctctgtgattgtgtcattgtagtggggaatagacactttaaagcccaccgctccgtgctggcagcatgcagcacgcatttccgagccctgttctcagtggcagaaggagatcagaccatgaacatgatccagctggatagcgaggtggtgacagcagaggcctttgctgcactgattgacatgatgtatacctccaccctcatgctgggggagagcaatgtaatggatgtcttattggcagcctctcacctgcatttgaactctgttgttaaggcatgtaaacattacttaacgacaaggacgctgcccatgtctccccccagtgagcgcgttcaggagcagagcgcccgcatgcagcgctcctttatgctacagcagctgggactaagcatcgtgagctcagccctcaattccagccagaatggcgaggagcagccagcccccatgagctcttccatgcgcagtaacctggatcagcgcacgcccttccccatgagacgccttcataagcgcaagcagtctgcagaggagcgggccaggcagcgcctccgaccctccatagatgagtctgccatttcagatgttacaccggagaatgggccttcaggggttcattctcgggaggagttcttttcaccagattctctgaaaattgtggataatcctaaagctgacggaatgactgataaccaggaagatagtgcgatcatgtttgatcagtcttttggcactcaagaagatgcccaggtgcccagccagtctgataacagtgctggcaacatggcacagttgtccatggcctctcgtgcaactcaggttgagactagttttgatcaggaagctgcacctgagaaaagtagttttcagtgtgaaaaccctgaggttggccttggtgagaaggagcacatgagagtggtggttaaatctgagcccctgagctcacctgagcctcaggatgaagtgagcgatgtgacctcacaagcagaaggcagcgagtctgtggaagtggaaggagttgtggtcagtgccgagaagatagacctcagccctgaaagcagtgatcggagtttttcagatccccagtctagcacagacagggtaggtgatatccatattttggaagtcacaaataacctagagcataagtccacttttagtatttcgaattttcttaacaagagcagaggaaataactttactgcaaatcagaacaatgatgataatattccaaacaccactagtgactgcaggctggagagtgaggccccctatttgttgagtccagaggctgggcctgcaggtgggccctcctctgcccctggctcccatgtagagaacccatttagtgaacctgcagactcccacttcgtcaggcctatgcaggaggtgatgggcctgccgtgtgtgcagacttcaggctaccaaggaggagaacagtttgggatggacttttccaggtctggtttgggcctccactcctccttctccagggtaatgataggttccccaaggggaggagccagtaactttccttactaccgccgcatagctcccaaaatgccagttgtaacttccgtcaggagctcacagatcccagaaaactctaccagttctcagctaatgatgaatggagctacgtcctcatttgaaaatggccatccttcccagcctggccctccacagttgaccagggcatctgcagatgttctgtcaaagtgcaagaaggccttatcagagcacaatgttttggttgtagagggagctcgcaagtatgcctgcaaaatctgctgcaaaacttttctgactttgacagattgcaagaagcacatccgtgttcacacaggtgaaaagccttacgcctgcctgaagtgtggcaagaggtttagtcagtccagccacctgtataagcactcaaagactacctgcctgcgctggcagagcagcaatcttcccagcactttgctctagctgtttgtccttacaagacaacgctgaggccagttgtcagactgaatttcttttggtaagcagttaatgcctttgggttcgaggcttccagctgcccagtggctcttaaacagtttagcaactaataaccggagaactaacatgtagtatttgtgctgctgcatttctgagtgaagtgcacgtcttgggaaagggatgcaatccctgaaaccaggtgcttccttggggttgagtaatgcagtcagaaagtagtttgtaattgatattaaaagtggcacatttaaaaatttaaaaattgaagtgcaaaaaaaattttttagcaatttttgtaaaactgtgtagcatttaaatttcctataccttctgatgggagtattatatccctgtatagtgatgcaaaatgcacttatgtgtaaccagtggtgatttggtgcctgtcttaaaggaaggcctttgaggacacacctgtctgccacaaatgctttaaagtgtatcatgagctagtcctaggcctcaaagtactgtattttttatttttacctgatttgcagtcataaacactgcactttggtgctgacactgggtccagagtgagcattctcttggactattagatgtatatacttttgaatacatcactgttggatagatgttttaacagttttttctggtttaaaaaccaaattgtaaatggagtgtgtacttgtagagagtgacaaggtattgtttccctatgtgctgtttgagcagtattttaaccaacttgtattacagatgttacagttccatgttaggaagtcagaaaagacttgtgtttgtctttgttctgctgatgtggagtcatgttttgtggggtcttccatggcacatttacctgttgctccgtccagatgttgagggccagtctaggctgacacatcctacccgaggacaagcctgttctccatttcttcactctcccctccccatatagcaactctcccaggtttagattaccgttttcgacgacagattaaccaaaaatgccccacacaggttttattactgttatatactatacttttaacagtacagaccctaaattttattatttgttgctcccccaatctgataccaaatgtttaaagttgtttgaaatccaaacatggtagtgttcatgggtaaatattttctaggctatgtaagagttagcagcccatagcatagaagtaatcaagtagcatctgagactgttggaggcactagggcctctctgggccctacagcctcacttccccagcctcaccttgctgtcctctgacactgccatcagggctgttagtggcacctgtatgaggccaagtgtgcgtccaggggaacagcacaggttaatgcgtctccctagaactcatgaagtcagtttaattcatgcatgaacatgagttcattttatgttttatatagctttcttagacataccaaaccatcattcataaatcagataaattattcagtttttgtgtttagaaagctaagtatgtgtagctggaaacaaaaatgagcgtgttttctctcctgttaatctagagtgtgcagttacacatgtgtggataatttcatgttccaggggcgcttggcatctcccatggactgattcccaggaagaaaagcccaaagggaaacccacgattcctttcgagtagatgtgggaaagagcccattggaggatatgaggtcctgtgaaattcagttgtgtgtgtggctccttgttagcagtcatgttgacatggtgttaggaggctccccatccaccctttacatgatgtagggaccagtgtcttgtgagattaaccttgggacacagtgggttagcctggagaaaatgagaggccctgcctggacccagggagaggagccagtgacacaggcagagcggtgcagccctccttcccttccatttggaggaggtggtgccaggagcctgcccgcttacctctgctgaagcataagtggactttgcttttggggcttatctctgatacatgctggagccctgcctctccactgctagatggaacctggaatctctcatctacctcttagtctgtcagtttctacgtgtgagaagcaagcttgtgggccagtgtccttgtacatgctgtagcacttaaaaaataattccagggttccctggaaaaccagtcccagggttcctatgatctgtagtttctacctggattataactggttttgggtacctgaattttgattggttagccttaattatagtctggcgtgatcatgtagaatcttttctggtgaacagatcataaagttctatcaaggagttctatcaaggcatccatgtcagtggtgctatgctggttacaacttgagatttttgaaataaaaaatttgtcata

SEQ ID NO: 334892 - DNA, 2718 bp, Homo sapiens
ggcaagaaggccttatcagagcatctgcactttgaccagggcatctgcagatgttctgtcaaagtgcaagaaggccttatcagagcacaatgttttggttgtagagggagctcgcaagtatgcctgcaaaatctgctgcaaaacttttctgactttgacagattgcaagaagcacatccgtgttcacacaggtgaaaagccttacgcctgcctgaagtgtggcaagaggtttagtcagtccagccacctgtataagcactcaaagactacctgcctgcgctggcagagcagcaatcttcccagcactttgctctagctgtttgtccttacaagacaacgctgaggccagttgtcagactgaatttcttttggtaagcagttaatgcctttgggttcgaggcttccagctgcccagtggctcttaaacagtttagcaactaataaccggagaactaacatgtagtatttgtgctgctgcatttctgagtgaagtgcacgtcttgggaaagggatgcaatccctgaaaccaggtgcttccttggggttgagtaatgcagtcagaaagtagtttgtaattgatattaaaagtggcacatttaaaaatttaaaaattgaagtgcaaaaaaaattttttagcaatttttgtaaaactgtgtagcatttaaatttcctataccttctgatgggagtattatatccctgtatagtgatgcaaaatgcacttatgtgtaaccagtggtgatttggtgcctgtcttaaaggaaggcctttgaggacacacctgtctgccacaaatgctttaaagtgtatcatgagctagtcctaggcctcaaagtactgtattttttatttttacctgatttgcagtcataaacactgcactttggtgctgacactgggtccagagtgagcattctcttggactattagatgtatatacttttgaatacatcactgttggatagatgttttaacagttttttctggtttaaaaaccaaattgtaaatggagtgtgtacttgtagagagtgacaaggtattgtttccctatgtgctgtttgagcagtattttaaccaacttgtattacagatgttacagttccatgttaggaagtcagaaaagacttgtgtttgtctttgttctgctgatgtggagtcatgttttgtggggtcttccatggcacatttacctgttgctccgtccagatgttgagggccagtctaggctgacacatcctacccgaggacaagcctgttctccatttcttcactctcccctccccatatagcaactctcccaggtttagattaccgttttcgacgacagattaaccaaaaatgccccacacaggttttattactgttatatactatacttttaacagtacagaccctaaattttattatttgttgctcccccaatctgataccaaatgtttaaagttgtttgaaatccaaacatggtagtgttcatgggtaaatattttctaggctatgtaagagttagcagcccatagcatagaagtaatcaagtagcatctgagactgttggaggcactagggcctctctgggccctacagcctcacttccccagcctcaccttgctgtcctctgacactgccatcagggctgttagtggcacctgtatgaggccaagtgtgcgtccaggggaacagcacaggttaatgcgtctccctagaactcatgaagtcagtttaattcatgcatgaacatgagttcattttatgttttatatagctttcttagacataccaaaccatcattcataaatcagataaattattcagtttttgtgtttagaaagctaagtatgtgtagctggaaacaaaaatgagcgtgttttctctcctgttaatctagagtgtgcagttacacatgtgtggataatttcatgttccaggggcgcttggcatctcccatggactgattcccaggaagaaaagcccaaagggaaacccacgattcctttcgagtagatgtgggaaagagcccattggaggatatgaggtcctgtgaaattcagttgtgtgtgtggctccttgttagcagtcatgttgacatggtgttaggaggctccccatccaccctttacatgatgtagggaccagtgtcttgtgagattaaccttgggacacagtgggttagcctggagaaaatgagaggccctgcctggacccagggagaggagccagtgacacaggcagagcggtgcagccctccttcccttccatttggaggaggtggtgccaggagcctgcccgcttacctctgctgaagcataagtggactttgcttttggggcttatctctgatacatgctggagccctgcctctccactgctagatggaacctggaatctctcatctacctcttagtctgtcagtttctacgtgtgagaagcaagcttgtgggccagtgtccttgtacatgctgtagcacttaaaaaataattccagggttccctggaaaaccagtcccagggttcctatgatctgtagtttctacctggattataactggttttgggtacctgaattttgattggttagccttaattatagtctggcgtgatcatgtagaatcttttctggtgaacagatcataaagttctatcaaggagttctatcaaggcatccatgtcagtggtgctatgctggttacaacttgagatttttgaaataaaaaatttgtcata

SEQ ID NO: 334893 - DNA, 4647 bp, Homo sapiens
gcgaactggctggaggagctaggggactagaggcggggtgggaggggggcgggtggaagggggaggaagtcccgtaacggagacgctggtcaggacgttcccacctcctctgacactgccgagtccgatcggagaggggtcaccgcctccttcagcgaggaggaggggggcggagcccgactcaggatcatggattttcctggtcactttgaacaaatcttccagcagctgaactaccagagacttcatggccagctctgtgattgtgtcattgtagtggggaatagacactttaaagcccaccgctccgtgctggcagcatgcagcacgcatttccgagccctgttctcagtggcagaaggagatcagaccatgaacatgatccagctggatagcgaggtggtgacagcagaggcctttgctgcactgattgacatgatgtatacctccaccctcatgctgggggagagcaatgtaatggatgtcttattggcagcctctcacctgcatttgaactctgttgttaaggcatgtaaacattacttaacgacaaggacgctgcccatgtctccccccagtgagcgcgttcaggagcagagcgcccgcatgcagcgctcctttatgctacagcagctgggactaagcatcgtgagctcagccctcaattccagccagaatggcgaggagcagccagcccccatgagctcttccatgcgcagtaacctggatcagcgcacgcccttccccatgagacgccttcataagcgcaagcagtctgcagaggagcgggccaggcagcgcctccgaccctccatagatgagtctgccatttcagatgttacaccggagaatgggccttcaggggttcattctcgggaggagttcttttcaccagattctctgaaaattgtggataatcctaaagctgacggaatgactgataaccaggaagatagtgcgatcatgtttgatcagtcttttggcactcaagaagatgcccaggtgcccagccagtctgataacagtgctggcaacatggcacagttgtccatggcctctcgtgcaactcaggttgagactagttttgatcaggaagctgcacctgagaaaagtagttttcagtgtgaaaaccctgaggttggccttggtgagaaggagcacatgagagtggtggttaaatctgagcccctgagctcacctgagcctcaggatgaagtgagcgatgtgacctcacaagcagaaggcagcgagtctgtggaagtggaaggagttgtggtcagtgccgagaagatagacctcagccctgaaagcagtgatcggagtttttcagatccccagtctagcacagacagggtaggtgatatccatattttggaagtcacaaataacctagagcataagtccacttttagtatttcgaattttcttaacaagagcagaggaaataactttactgcaaatcagaacaatgatgataatattccaaacaccactagtgactgcaggctggagagtgaggccccctatttgttgagtccagaggctgggcctgcaggtgggccctcctctgcccctggctcccatgtagagaacccatttagtgaacctgcagactcccacttcgtcaggcctatgcaggaggtgatgggcctgccgtgtgtgcagacttcaggctaccaaggaggagaacagtttgggatggacttttccaggtctggtttgggcctccactcctccttctccagggtaatgataggttccccaaggggaggagccagtaactttccttactaccgccgcatagctcccaaaatgccagttgtaacttccgtcaggagctcacagatcccagaaaactctaccagttctcagctaatgatgaatggagctacgtcctcatttgaaaatggccatccttcccagcctggccctccacagttgaccagggcatctgcagatgttctgtcaaagtgcaagaaggccttatcagagcacaatgttttggttgtagagggagctcgcaagtatgcctgcaaaatctgctgcaaaacttttctgactttgacagattgcaagaagcacatccgtgttcacacaggtgaaaagccttacgcctgcctgaagtgtggcaagaggtttagtcagtccagccacctgtataagcactcaaagactacctgcctgcgctggcagagcagcaatcttcccagcactttgctctagctgtttgtccttacaagacaacgctgaggccagttgtcagactgaatttcttttggtaagcagttaatgcctttgggttcgaggcttccagctgcccagtggctcttaaacagtttagcaactaataaccggagaactaacatgtagtatttgtgctgctgcatttctgagtgaagtgcacgtcttgggaaagggatgcaatccctgaaaccaggtgcttccttggggttgagtaatgcagtcagaaagtagtttgtaattgatattaaaagtggcacatttaaaaatttaaaaattgaagtgcaaaaaaaattttttagcaatttttgtaaaactgtgtagcatttaaatttcctataccttctgatgggagtattatatccctgtatagtgatgcaaaatgcacttatgtgtaaccagtggtgatttggtgcctgtcttaaaggaaggcctttgaggacacacctgtctgccacaaatgctttaaagtgtatcatgagctagtcctaggcctcaaagtactgtattttttatttttacctgatttgcagtcataaacactgcactttggtgctgacactgggtccagagtgagcattctcttggactattagatgtatatacttttgaatacatcactgttggatagatgttttaacagttttttctggtttaaaaaccaaattgtaaatggagtgtgtacttgtagagagtgacaaggtattgtttccctatgtgctgtttgagcagtattttaaccaacttgtattacagatgttacagttccatgttaggaagtcagaaaagacttgtgtttgtctttgttctgctgatgtggagtcatgttttgtggggtcttccatggcacatttacctgttgctccgtccagatgttgagggccagtctaggctgacacatcctacccgaggacaagcctgttctccatttcttcactctcccctccccatatagcaactctcccaggtttagattaccgttttcgacgacagattaaccaaaaatgccccacacaggttttattactgttatatactatacttttaacagtacagaccctaaattttattatttgttgctcccccaatctgataccaaatgtttaaagttgtttgaaatccaaacatggtagtgttcatgggtaaatattttctaggctatgtaagagttagcagcccatagcatagaagtaatcaagtagcatctgagactgttggaggcactagggcctctctgggccctacagcctcacttccccagcctcaccttgctgtcctctgacactgccatcagggctgttagtggcacctgtatgaggccaagtgtgcgtccaggggaacagcacaggttaatgcgtctccctagaactcatgaagtcagtttaattcatgcatgaacatgagttcattttatgttttatatagctttcttagacataccaaaccatcattcataaatcagataaattattcagtttttgtgtttagaaagctaagtatgtgtagctggaaacaaaaatgagcgtgttttctctcctgttaatctagagtgtgcagttacacatgtgtggataatttcatgttccaggggcgcttggcatctcccatggactgattcccaggaagaaaagcccaaagggaaacccacgattcctttcgagtagatgtgggaaagagcccattggaggatatgaggtcctgtgaaattcagttgtgtgtgtggctccttgttagcagtcatgttgacatggtgttaggaggctccccatccaccctttacatgatgtagggaccagtgtcttgtgagattaaccttgggacacagtgggttagcctggagaaaatgagaggccctgcctggacccagggagaggagccagtgacacaggcagagcggtgcagccctccttcccttccatttggaggaggtggtgccaggagcctgcccgcttacctctgctgaagcataagtggactttgcttttggggcttatctctgatacatgctggagccctgcctctccactgctagatggaacctggaatctctcatctacctcttagtctgtcagtttctacgtgtgagaagcaagcttgtgggccagtgtccttgtacatgctgtagcacttaaaaaataattccagggttccctggaaaaccagtcccagggttcctatgatctgtagtttctacctggattataactggttttgggtacctgaattttgattggttagccttaattatagtctggcgtgatcatgtagaatcttttctggtgaacagatcataaagttctatcaaggagttctatcaaggcatccatgtcagtggtgctatgctggttacaacttgagatttttgaaataaaaaatttgtcatattcatgcctctaaaaaaaaatt

SEQ ID NO: 334894 - DNA, 4667 bp, Homo sapiens
gcgaactggctggaggagctaggggactagaggcggggtgggaggggggcgggtggaagggggaggaagtcccgtaacggagacgctggtcaggacgttcccacctcctctgacactgccgagtccgatcggagaggggtcaccgcctccttcagcgaggaggaggggggcggagcccgactcaggatcatggattttcctggtcactttgaacaaatcttccagcagctgaactaccagagacttcatggccagctctgtgattgtgtcattgtagtggggaatagacactttaaagcccaccgctccgtgctggcagcatgcagcacgcatttccgagccctgttctcagtggcagaaggagatcagaccatgaacatgatccagctggatagcgaggtggtgacagcagaggcctttgctgcactgattgacatgatgtatacctccaccctcatgctgggggagagcaatgtaatggatgtcttattggcagcctctcacctgcatttgaactctgttgttaaggcatgtaaacattacttaacgacaaggacgctgcccatgtctccccccagtgagcgcgttcaggagcagagcgcccgcatgcagcgctcctttatgctacagcagctgggactaagcatcgtgagctcagccctcaattccagccagaatggcgaggagcagccagcccccatgagctcttccatgcgcagtaacctggatcagcgcacgcccttccccatgagacgccttcataagcgcaagcagtctgcagaggagcgggccaggcagcgcctccgaccctccatagatgagtctgccatttcagatgttacaccggagaatgggccttcaggggttcattctcgggaggagttcttttcaccagattctctgaaaattgtggataatcctaaagctgacggaatgactgataaccaggaagatagtgcgatcatgtttgatcagtcttttggcactcaagaagatgcccaggtgcccagccagtctgataacagtgctggcaacatggcacagttgtccatggcctctcgtgcaactcaggttgagactagttttgatcaggaagctgcacctgagaaaagtagttttcagtgtgaaaaccctgaggttggccttggtgagaaggagcacatgagagtggtggttaaatctgagcccctgagctcacctgagcctcaggatgaagtgagcgatgtgacctcacaagcagaaggcagcgagtctgtggaagtggaaggagttgtggtcagtgccgagaagatagacctcagccctgaaagcagtgatcggagtttttcagatccccagtctagcacagacagggtaggtgatatccatattttggaagtcacaaataacctagagcataagtccacttttagtatttcgaattttcttaacaagagcagaggaaataactttactgcaaatcagaacaatgatgataatattccaaacaccactagtgactgcaggctggagagtgaggccccctatttgttgagtccagaggctgggcctgcaggtgggccctcctctgcccctggctcccatgtagagaacccatttagtgaacctgcagactcccacttcgtcaggcctatgcaggaggtgatgggcctgccgtgtgtgcagacttcaggctaccaaggaggagaacagtttgggatggacttttccaggtctggtttgggcctccactcctccttctccagggtaatgataggttccccaaggggaggagccagtaactttccttactaccgccgcatagctcccaaaatgccagttgtaacttccgtcaggagctcacagatcccagaaaactctaccagttctcagctaatgatgaatggagctacgtcctcatttgaaaatggccatccttcccagcctggccctccacagttgaccagggcatctgcagatgttctgtcaaagtgcaagaaggccttatcagagcacaatgttttggttgtagagggagctcgcaagtatgcctgcaaaatctgctgcaaaacttttctgactttgacagattgcaagaagcacatccgtgttcacacaggtgaaaagccttacgcctgcctgaagtgtggcaagaggtttagtcagtccagccacctgtataagcactcaaagactacctgcctgcgctggcagagcagcaatcttcccagcactttgctctagctgtttgtccttacaagacaacgctgaggccagttgtcagactgaatttcttttggtaagcagttaatgcctttgggttcgaggcttccagctgcccagtggctcttaaacagtttagcaactaataaccggagaactaacatgtagtatttgtgctgctgcatttctgagtgaagtgcacgtcttgggaaagggatgcaatccctgaaaccaggtgcttccttggggttgagtaatgcagtcagaaagtagtttgtaattgatattaaaagtggcacatttaaaaatttaaaaattgaagtgcaaaaaaaattttttagcaatttttgtaaaactgtgtagcatttaaatttcctataccttctgatgggagtattatatccctgtatagtgatgcaaaatgcacttatgtgtaaccagtggtgatttggtgcctgtcttaaaggaaggcctttgaggacacacctgtctgccacaaatgctttaaagtgtatcatgagctagtcctaggcctcaaagtactgtattttttatttttacctgatttgcagtcataaacactgcactttggtgctgacactgggtccagagtgagcattctcttggactattagatgtatatacttttgaatacatcactgttggatagatgttttaacagttttttctggtttaaaaaccaaattgtaaatggagtgtgtacttgtagagagtgacaaggtattgtttccctatgtgctgtttgagcagtattttaaccaacttgtattacagatgttacagttccatgttaggaagtcagaaaagacttgtgtttgtctttgttctgctgatgtggagtcatgttttgtggggtcttccatggcacatttacctgttgctccgtccagatgttgagggccagtctaggctgacacatcctacccgaggacaagcctgttctccatttcttcactctcccctccccatatagcaactctcccaggtttagattaccgttttcgacgacagattaaccaaaaatgccccacacaggttttattactgttatatactatacttttaacagtacagaccctaaattttattatttgttgctcccccaatctgataccaaatgtttaaagttgtttgaaatccaaacatggtagtgttcatgggtaaatattttctaggctatgtaagagttagcagcccatagcatagaagtaatcaagtagcatctgagactgttggaggcactagggcctctctgggccctacagcctcacttccccagcctcaccttgctgtcctctgacactgccatcagggctgttagtggcacctgtatgaggccaagtgtgcgtccaggggaacagcacaggttaatgcgtctccctagaactcatgaagtcagtttaattcatgcatgaacatgagttcattttatgttttatatagctttcttagacataccaaaccatcattcataaatcagataaattattcagtttttgtgtttagaaagctaagtatgtgtagctggaaacaaaaatgagcgtgttttctctcctgttaatctagagtgtgcagttacacatgtgtggataatttcatgttccaggggcgcttggcatctcccatggactgattcccaggaagaaaagcccaaagggaaacccacgattcctttcgagtagatgtgggaaagagcccattggaggatatgaggtcctgtgaaattcagttgtgtgtgtggctccttgttagcagtcatgttgacatggtgttaggaggctccccatccaccctttacatgatgtagggaccagtgtcttgtgagattaaccttgggacacagtgggttagcctggagaaaatgagaggccctgcctggacccagggagaggagccagtgacacaggcagagcggtgcagccctccttcccttccatttggaggaggtggtgccaggagcctgcccgcttacctctgctgaagcataagtggactttgcttttggggcttatctctgatacatgctggagccctgcctctccactgctagatggaacctggaatctctcatctacctcttagtctgtcagtttctacgtgtgagaagcaagcttgtgggccagtgtccttgtacatgctgtagcacttaaaaaataattccagggttccctggaaaaccagtcccagggttcctatgatctgtagtttctacctggattataactggttttgggtacctgaattttgattggttagccttaattatagtctggcgtgatcatgtagaatcttttctggtgaacagatcataaagttctatcaaggagttctatcaaggcatccatgtcagtggtgctatgctggttacaacttgagatttttgaaataaaaaatttgtcataaaaaaaaaagtcgacgcggccgcgaatttagtagtagtagta

SEQ ID NO: 334895 - DNA, 479 bp, Homo sapiens
tgtctgagaaagtctttatctatgttgatgattcttttcttgcaatgctttaaatatttcaccctgctcttttcttgcttgcttggtttctaaagagaaattcaatataattcttatccttactcttctataaacaaggtgtttttccccgctagtatcttccaaataattctctttgcatttgaaattcttcagtttgaaaatcatatgcctaagcataggctgttatgtttgtgtgttcgtttgtttgccattatcctgctcaatgttctctgagcattcctggatctgtggtttggtgtccggcattaatcttgggatattctcagtcactatttctatacatatctcctctgtttctttctctcttgcttttgtttctgatattctcattacacatacgttgcatcttctgttatgatcccacagttcttagattttctgttctgttttcttaagtctttctctttgcttttcag

SEQ ID NO: 334896 - DNA, 334 bp, Homo sapiens
ccaggggtgattatactcttgaacttcaaatatgtaaacttaagcttgacacaacaagaaatagcgatggtgaaataaattggaaactccagtagaccagagttagttggtagcccgaggttgtgttctagctttgccactggctcacgctgtgaacttaagcagatccccactaatccctaggcctcagtgttcccatgtacacgaggggtgggattcgatggtatccaaaggccttcctggtattgatggtttgacattctaggccatctggtcccagaaggtactgtggggcaggagaccagctcatggtggagacctgagcaagccagga

SEQ ID NO: 334897 - DNA, 508 bp, Homo sapiens
agaggtccaacaacatgtaattatctgttctaattcatggtgaattacagtatttaataatattttttaaaattatcataaaaagctaattcatttgtgaacacaaatttttcttaattcccacttcatgacgtattagttttatgatcacgttaggcttactccacaaacatttattggtatctgctttatccatggagtcacagcaggtgatagaggatttgtaaccctctcccctttccctgccactccactgagaagcagatatcatggcatgaatgattaaataggagactatatttcatttataaaatggcttaggaacttttacagatgaaagaaactgttcttgaaactgccaataatatcaggaaagtgaatactaggtcttatttgttctttttaatgattttttcatacccattaaccattctcacccccacctccccatcctccatggccccactacccttctcagcctctggtaaccatccttctactctctgtg

SEQ ID NO: 334898 - DNA, 550 bp, Homo sapiens
tggtcatagccgattcctgagtgtacaacgacgcatatggcctacgattcatcgacatagctgttttcgtgctaattcatggtgaattacagtatttaataatattttttaaaattatcataaaaagctaattcatttgtgaacacaaatttttcttaattcccacttcatgacgtattagttttatgatcacgttaggcttactccacaaacatttattggtatctgctttatccatggagtcacagcaggtgatagaggatttgtaaccctctcccctttccctgccactccactgagaagcagatatcatggcatgaatgattaaataggagactatatttcatttataaaatggcttaggaacttttacagatgaaagaaactgttcttgaaactgccaataatatcaggaaagtgaatactaggtcttatttgttctttttaatgattttttcatacccattaaccattctcacccccacctccccatcctccatggccccactacccttctcagcctctggtaaccatccttctactctctgtg

SEQ ID NO: 334899 - DNA, 142 bp, Homo sapiens
ccagttgctgacatagactcatggctgtcggccaaaggtctcaaccacccttggagcattctggagtggtcagacactactggacaatggatgagcttgtgccctgcatggtcagtctcccttccaggcccccttctgctct

SEQ ID NO: 334900 - DNA, 430 bp, Homo sapiens
gcccaaagagaaagcctttcccttaaaattggtctctccagccctgataagttccccgtctccactagccatatgcctgttcttgcaggtgccaaagttcaaaatgttaatatctttgactctcccatctccctggcagcttcccgtggtcaccagggcttggctctgcatctctcctctccttctgggccccactgtgaccccaccactcttcttcattgatctccctgctctgggctcgtccctaccaaacccctgtgaactaatggcccactttattgtaagagttattgtcttaaaatagcacgggttgagaaaatttccacaatggctattgaataatgcaggaattccttggtcctaaacctgttctcaacctacctttctggacctatccgtaggttccctctccctgaacaggtccaggcag

SEQ ID NO: 334901 - DNA, 717 bp, Homo sapiens
aatttaagtatttttaattctcccagttgtgtgtaatttatttcagttgtaatttatttgcattagaaaagcgaactctatgtgttattgtactttgattcaaaatagctatgttaaaaaattaaaattttctaaactgtacatttaaattgtatgctacagtgtcccgattggcaagttagaagaaaacttcaccagcaagcaaaatataggatttgaattcttaatggttttttgcacttctgttttttaatatccatcgtcaccatctttctatttagtcttagaagagttattactgtccaaataaattttcagcgatgatggaaatttttatatcagcactgtccattgtggtagccacttgaatgtgcctcatctgaggaactatatttaattttatttaattgtaattagttcaagtaggtacatgtgcttagtggctactatatggatagcacagctctagaacctaggtcaacaggagcatctggatcacacaggagtatctggctgtgtaggaagatttttgaagcaatatcaggcctggatatcttcagtggaatcaatttacagatccttgactttctaaactgatgagcctaagaaagtgtctgggtctgttagtgctgctttctgacctcctctttaatacttgcttttttactgctttgcaaaagaaagagttatcgcacctgttctctgggggtgaaaatg

SEQ ID NO: 334902 - DNA, 331 bp, Homo sapiens
acacacacacacacacacacacacacacacacacaatacttgccatatcaagttaaaattgttaattttaatatgaaatgtgtgagataggtatccagtttcattccctattaaatatggaacgtttttcttgcacaatgtattttaagattccatctttcctcatttttttctgttttaaatgaagtttgtctgtttatggatttcctattttgtttcatttatcagtactgtctttatgccagtagcacattgtctaattctatcgttatagttttcctttgtattttcgttaacaaaaactccctccgctttcttttccttgaagtat

SEQ ID NO: 334903 - DNA, 714 bp, Homo sapiens
gcagcgtgtccactaaagacgctccctctatgtgcctctgccttgagagtgggcgtggggggaggcgtggcagaccggaggcagagcttcctgggcgccaaggcaaagggaggaaacaaaagccatgtctggctaaaggccagactcaaaccatgggggcagcggcagggagtcttcagtgatgtggaaagatgggttctgctgctcatctcagaggagaggacaagaaacccagacatgctaggccgtgtgcggtggctcacgcctgtaatcccagcactttgggaggccaaggcaggcggatcatgaggtcaggagatcgagatcatcctggctaacatggtgaaaccccgtctctactaaaaatacaaaaataaaattagctgggtgtggtggtggatgcctatagtcccagctactcgggaggctgaggtgggagaatggcgtgaacccgggaggcggagcttgcagtggtgcagagatcatgccactgcactccagcctgggcgacagagcatgactccgtctcaaaaaaaaatacaaaaatttagccgggcatggtggtgtgcacctgtagtcccagctacttgggaggctgaggcgggagaattgattgaacctgggaggtggaggttgcagtgagccgagatcgcgccattgcactccagcctgggcaacagggtgagactccatctcaaaaaaaaaaaaagaaag

SEQ ID NO: 334904 - DNA, 163 bp, Homo sapiens
catgcacaaacataaactttcagcaccagaaatgtcatccaatggcccatttaaaaaagtcagtgaatttgtttggttgtatttctgccatcgtacagaatctgagcatctccataacttcaatttccctttcttttttttccagctttattgaggcattctt

SEQ ID NO: 334905 - DNA, 337 bp, Homo sapiens
gaggatcacttgagaccgggagtccaagaccagcctcgttaatataatgagagcttatctctacaaaaaataaacaaaattagccaggcatggtggcatgtgcctgtagttccagctactcaggaggctgaggtaggatcaccggagcccagggggtggaggagcagtaagccaagattctgccactgcactccagcctggctgacagagtaagaccctatctcaaaaaacaaaaagcagaaagaacaaagaagtaaacagaagcttaaaagtaaatcagccatgagccacggtgcccagcctgtttatggacattttaagttgtgcatatgccaaa

SEQ ID NO: 334906 - DNA, 435 bp, Homo sapiens
tccgcctgctactcggtcccggcgctgggctgaggggaggggttgtcttaaaagtctctccttccccctgtaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtctgagttgg

SEQ ID NO: 334907 - DNA, 178 bp, Homo sapiens
agggaggttgaggctgcagtgagtcatgattgtgccacgtaccccagtctgggtgacagagtgaaaccctatctcaaaaaaaaaagaaaacgttgaatgaaagagatgtttagattagaagcaatgcaggaatttgcggaagaccttaacaggttaaaaaaaaaaaaagtaggaaaaa

SEQ ID NO: 334908 - DNA, 324 bp, Homo sapiens
agggagttccccgaccccttgcacttcccgggtgaggcaacaccacaccctccttcggctcatcctccgtgggcttcacccgctgtctaaccagtcccagtgagatgagccatgtaactcagttggaaatgcagaaatcacccaccttttgtgttgatcttgctgggatttgcagactggagctgttcctattaggacattttgccagccactccactattttttttcattattacttcatcatttagtttttctatttaagtgatgtttatgcaccacatttacagtgttatattagtctgtgttttctgtctccttactatt

SEQ ID NO: 334909 - DNA, 93 bp, Homo sapiens
tcatgagaagataatttccaagagggagagtgagcagtagtcaaaactataaaaattagagctaaactgagaaataaaaacatatacaactaa

SEQ ID NO: 334910 - DNA, 147 bp, Homo sapiens
ctaagcactctccattgtaggtcagtgtatatcagagaaacacaggcagttcttccacaagggcaggactttaatcagacatcaagtactgagttaatgatttaaaatgcccacattgcacagccttgttgttgttgtttttttttt

SEQ ID NO: 334911 - DNA, 642 bp, Homo sapiens
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 334912 - DNA, 697 bp, Homo sapiens
gcgcatgcttgtgcgtgaagctagccgattgtcaccaccgcgtagttattcgtggtgtcatttagcattgtcaactggccgaccgtcgttacaagggggaactcggctagcggccccacagcccctgctgactcaaaacaactgagttgtaagacgttcatcgccgtgttatccttgagtaaagaagcgggcttttgccatgttgtccaggctggtctctactcctgggctcaagcagtcctcctgcctcagtctcccaaagtgctggaattacagggaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 334913 - DNA, 832 bp, Homo sapiens
ataaatccccgtatttttgttaaaggctgggtaacctgactcctcccctcatttctactgcaaaataggagtacactggggcctcccagtggagctgttctctgctgttttaaattactttctactcctccctttctaacgtccactcctggactcatttgttagatcaatatatactgggactgttgtgttttctttgagtgtactagatctctttccagaagagcttcccttgatccagatctccctaattgggaatgatgatttcacagactagagtctccgatgctggtcatgatgtcaaaactaagttctgactcatttagggaactggatacttgggtctccagaagggccaatgggagggccataattctgtttattttcaaattgtcttgttttcaccttgttagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 334914 - DNA, 1120 bp, Homo sapiens
  misc_feature (657)..(657): n is a, c, g, or t
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaaaaaaaaaaaaaaaanaaaaaaaaaaaaaaaaaggggggggcccacatcagaagagatacccgagaggggggccccacgtattagcgggcaaccacgcgtatcgtcgggacaacaagtggagcgccacagtagtaggaagcacgacaataaacagccacgggaaagtggcacgccgatgttacaaaacagacgacacagtggtaaaacaccggcaggtaggggacacaccatctgggagggaaaagcgaaacacccttacaacacatccgaggaggggggggacaccaatccactggggacaaacaaacttcccacaaaagaagagagttaaaaagccccgtaggggaacgcatacaaacgacgtgcaaccccgctacaacgcggagccagacacccaacacgcgacaaaaataggcgagcaggcgaacaacaaagccggcgcgacaaggggactacatgcggacagaaaattttaccg

SEQ ID NO: 334915 - DNA, 512 bp, Homo sapiens
ggtttggggtaggattatccccatcacccaggtagtgggcatagtacccaatagttattaaacctttgccccatttcctctccccagtgtctgttgccatctttatgtccatgtatactcaacatttagctcccacttacaagtaagaacatatggtatctggttttctgttctgtattgattcactgaggatcatggcctgtggttgcatccatgttgctgcaaaggatatgaaatcgtttttttattggtgcatctcatatggttctaatgttctttttattatttttcaggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 334916 - DNA, 454 bp, Homo sapiens
tccccgactagcccgacaggcccggatacacgttcgtcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtaatcccaactactcgggaggctgaggcaggagaatggctttgaaccagggagtccaaggttgcagtgagccgagatcgtgccactgcacttccagcctggcgacag

SEQ ID NO: 334917 - DNA, 635 bp, Homo sapiens
ttttttgagatggagtcttgatcttgttgcccgggctggcaatggtacgatctccctgcaacctctgcctcccgggttcaatcgattgtcctgcctcagcctgccgattagctgggactacaggcccgcgccaccacactcggctaatttttctgtttttagtagaaggggtttcaccatgttggccaggatggtctccatctcctgacctcgtgagccgctgtgcccggccactttttcttttttgagctataatccatgtaccacaggtggtgacttccatttgtttgtttttgctattttgtttttgagacagggcgcaatgccaggatctccctgcaacatccaccgtcagggctcaagtggtctttccacctcagcttcctgggactgcaggcacgtgctaccaccacgcctggctaatttttagtttttttacagaagcgggcttttgccatgttgtccaggctggtctctactcctgggctcaagcagtcctcctgcctcagtctcccaaagtgctggaattacaggggtgagttgctgcgtctggtgttggtgactttctagagattactttttggtttacatcattttccttgtgactatttttacttttttggggggcgggggga

SEQ ID NO: 334918 - DNA, 375 bp, Homo sapiens
tctccctctgtcacccaggctggagtgcagtggcgcggtctttgctcactgcaacctccacctcccaggttcaagcaattctcctcagcctggccaagatggtgaaaccccgtctctactaaaaatacaaaaattagcacgtgctaccaccacgcctggctaatttttagtttttttacagaagcgggcttttgccatgttgtccaggctggtctctactcctgggctcaagcagtcctcctgcctcagtctcccaaagtgctggaattacaggggtgagttgctgcgtctggtgttggtgactttctagagattactttttggtttacatcattttccttgtgactatttttacttttttggggggcgggggga

SEQ ID NO: 334919 - DNA, 1074 bp, Homo sapiens
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 334920 - DNA, 754 bp, Homo sapiens
tacggctaggtacgaggctggtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 334921 - DNA, 1168 bp, Homo sapiens
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaagcgggcttttgccatgttgtccaggctggtctctactcctgggctcaagcagtcctcctgcctcagtctcccaaagtgctggaattacagggaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 334922 - DNA, 1186 bp, Homo sapiens
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaaaaaaaaaaaaaatccgggttctatggggtgcgggaaaaggtagaatggctggcttgttcggaccgttttgcaggggaattgcggcccctttggggggttatgaaagcgatga

SEQ ID NO: 334923 - DNA, 1283 bp, Homo sapiens
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgtgagtggggttgggcgagtgattgcaaaatgggggtggcggtcgcccggggataggaagggagtgatgatgaccccaggtaactctgagtgtgtcgctgatgccatcaccgcagcgctctgaccgccccctcggtccagcatttctcaggctcaacgagttcatggccaagattcctaatcttttgttctgtttcatttccccgttaggagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 334924 - DNA, 611 bp, Homo sapiens
tacggctaggtacgaggctggtgggctcgtgggttggcagtatgagagttgtaatggcccgactgttgagtgagggggagcaggggatcccaacggcttgcgctgcctttgcgcagcagccggcgggcggccacgtcgcggcctggctggggagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 334925 - DNA, 1033 bp, Homo sapiens
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 334926 - DNA, 705 bp, Homo sapiens
tacggctaggtacgaggctggtgggctcgtgggttggcagtatgagagttgtaatggcccgactgttgagtgagggggagcaggggatcccaacggcttgcgctgcctttgcgcagcagccggcgggcggccacgtcgcggcctggctggggagttgtaagacgttcatcgccgtgttatccttgagtaaagaagcgggcttttgccatgttgtccaggctggtctctactcctgggctcaagcagtcctcctgcctcagtctcccaaagtgctggaattacagggaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 334927 - DNA, 954 bp, Homo sapiens
ttttttgagatggagtcttgatcttgttgcccgggctggcaatggtacgatctccctgcaacctctgcctcccgggttcaatcgattgtcctgcctcagcctgccgattagctgggactacaggcccgcgccaccacactcggctaatttttctgtttttagtagaaggggtttcaccatgttggccaggatggtctccatctcctgacctcgtgagccgctgtgcccggccactttttcttttttgagctataatccatgtaccacaggtggtgacttccatttgtttgtttttgctattttgtttttgagacagggcgcaatgccaggatctccctgcaacatccaccgtcagggctcaagtggtctttccacctcagcttcctgggactgcaggcacgtgctaccaccacgcctggctaatttttagtttttttacagaagcgggcttttgccatgttgtccaggctggtctctactcctgggctcaagcagtcctcctgcctcagtctcccaaagtgctggaattacagggaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 334928 - DNA, 1772 bp, Homo sapiens
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaaaaaaaaacaaaaaaaaaaaaaaaaaaaaaaaaaaaaaaaaaaaaaaaaaaaaaaaaaaatggtgggggggggtgggcccgggagaagttttaaaaaccaatatgtgggggggagaggggcacccagatgagatagaagaaaacggcgcaacaagggttcccaaagagaaacccgggcagagaaaagcgcggaggctttccacaaaataaaaacgcgccgggacacacacgagctgtgtttgagcaaaacaccacaacgggagcgctctagcagggccaaaacaggggggaccacaacacaaggaagcaaaagggagcgagaaaataatcggccagccgacgtggtgtgcgcaaccacaaacgcgcacccaaaagcacgaagaaagagctaaaaacagcgagaacagaagcaaaacgacagcgtgcgaagaaaggagaagaagaggagcgggggagagacaaagaagacgcgggaggaggcagaggacacaacggaggggggagcgggaggaggaagcgagagacagaacggacaggccggacggcagccgcaaaagagcaccagacacgagggagagcggggctgaggcggagggagaagcaggacaggagagaaggcaggcgcgaggacgagaacaacagacgacgagtggggaggggagcagaggagaggcgcgcggggcgagaagacagaacgat

SEQ ID NO: 334929 - DNA, 1611 bp, Homo sapiens
  misc_feature (1148)..(1148): n is a, c, g, or t
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaaaaaaaaacaaaaaaaaaaaaaaaaaaaaaaaaaaaaaaaaaaaaaaaaaaaaaaaaaaaaaaaaaaaaaaaaanaaaaaaaaaaaaaaaaaggggggggcccacatcagaagagatacccgagaggggggccccacgtattagcgggcaaccacgcgtatcgtcgggacaacaagtggagcgccacagtagtaggaagcacgacaataaacagccacgggaaagtggcacgccgatgttacaaaacagacgacacagtggtaaaacaccggcaggtaggggacacaccatctgggagggaaaagcgaaacacccttacaacacatccgaggaggggggggacaccaatccactggggacaaacaaacttcccacaaaagaagagagttaaaaagccccgtaggggaacgcatacaaacgacgtgcaaccccgctacaacgcggagccagacacccaacacgcgacaaaaataggcgagcaggcgaacaacaaagccggcgcgacaaggggactacatgcggacagaaaattttaccg

SEQ ID NO: 334930 - DNA, 1025 bp, Homo sapiens
  misc_feature (1000)..(1000): n is a, c, g, or t
  misc_feature (1025)..(1025): n is a, c, g, or t
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgatacaagactttgcttttaatataatattccncataaagccatttacagtaacatan

SEQ ID NO: 334931 - DNA, 1198 bp, Homo sapiens
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaagcgggcttttgccatgttgtccaggctggtctctactcctgggctcaagcagtcctcctgcctcagtctcccaaagtgctggaattacagggaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaaaaaaaaaaaccggggcttatgtcgggggga

SEQ ID NO: 334932 - DNA, 1038 bp, Homo sapiens
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaagtggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 334933 - DNA, 1050 bp, Homo sapiens
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaagtggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatattattctttactttaaaatgctttattggaattattttgataaaagcagatacttgtatataagacaaatatagg

SEQ ID NO: 334934 - DNA, 1403 bp, Homo sapiens
tacggctaggtacgaggctggtgggctcgtgggttggcagtatgagagttgtaatggcccgactgttgagtgagggggagcaggggatcccaacggcttgcgctgcctttgcgcagcagccggcgggcggccacgtcgcggcctggctggggagttgtaagacgttcatcgccgtgttatccttgagtaaagaagcgggcttttgccatgttgtccaggctggtctctactcctgggctcaagcagtcctcctgcctcagtctcccaaagtgctggaattacagggaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaaaaaaaaacaaaaaaaaaaaaaaaaaaaaaaaaaaaaaaaaaaaaaaaaaaaaaaaaaaatggtgggggggggtgggcccgggagaagttttaaaaaccaatatgtgggggggagaggggcacccagatgagatagaagaaaacggcgcaacaagggttcccaaagagaaacccgggcagagaaaagcgcggaggctttccacaaaataaaaacgcgccgggacacacacgagctgtgtttgagcaaaacaccacaacgggagcgctctagcagggccaaaacaggggggaccacaacacaaggaagcaaaagggagcgagaaaataatcggccagccgacgtggtgtgcgcaaccacaaacgcgcacccaaaagcacgaagaaagagctaaaaacagcgagaacagaagcaaaacgacagcgtgcgaagaaaggagaagaagaggagcgggggagagacaaagaagacgcgggaggaggcagaggacacaacggaggggggagcgggaggaggaagcgagagacagaacggacaggccggacggcagccgcaaaagagcaccagacacgagggagagcggggctgaggcggagggagaagcaggacaggagagaaggcaggcgcgaggacgagaacaacagacgacgagtggggaggggagcagaggagaggcgcgcggggcgagaagacagaacgat

SEQ ID NO: 334935 - DNA, 921 bp, Homo sapiens
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgtgagtggggttgggcgagtgattgcaaaatgggggtggcggtcgcccggggataggaagggagtgatgatgaccccaggtaactctgagtgtgtcgctgatgccatcaccgcagcgctctgaccgccccctcggtccagcatttctcaggctcaacgagttcatggccaagattcctaatcttttgttctgtttcatttccccgttaggagttgtaagacgttcatcgccgtgttatccttgagtaaaggtgagtattaggtgcgagagccttttgaatgcctcttcggaaagctttgttcccaag

SEQ ID NO: 334936 - DNA, 465 bp, Homo sapiens
cgatccatccctttccccatcccccaacaggccccggtgtgtgatgttcccctccctgtgtccatatgttctcattgttcaactcccacttacaagtaagaacatatggtatctggttttctgttctgtattgattcactgaggatcatggcctgtggttgcatccatgttgctgcaaaggatatgaaatcgtttttttattggtgcatctcatatggttctaatgttctttttattatttttcaggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 334937 - DNA, 923 bp, Homo sapiens
ggtttggggtaggattatccccatcacccaggtagtgggcatagtacccaatagttattaaacctttgccccatttcctctccccagtgtctgttgccatctttatgtccatgtatactcaacatttagctcccacttacaagtaagaacatatggtatctggttttctgttctgtattgattcactgaggatcatggcctgtggttgcatccatgttgctgcaaaggatatgaaatcgtttttttattggtgcatctcatatggttctaatgttctttttattatttttcaggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaaaaaaaaacaaaaaaaaaaaaaaaaaaaaaaaaaaaaaaaaaaaaaaaaaaaaaaaaaaataaaaaaaaacaaaattaaaaataccataccaaattttaaactcctttgcccatttcccctcttactactttcattacaattcacttttccccttttactacattctcacctttaaaaccctttctttcccacactcatctctcttctccatatcctctttcccaacttttctatttctcaaaactcccctcctaacgcctttccatttcttaccattctcattggcaatctaactggctaacctctgctcataacccggtccattatgtacaaacctctctgtcttatcccaatgtgccgctttgcattcccttttccctgctttgcctctttgggtccttttgcccccct

SEQ ID NO: 334938 - DNA, 913 bp, Homo sapiens
  misc_feature (721)..(721): n is a, c, g, or t
  misc_feature (725)..(726): n is a, c, g, or t
  misc_feature (729)..(729): n is a, c, g, or t
  misc_feature (731)..(731): n is a, c, g, or t
  misc_feature (735)..(735): n is a, c, g, or t
  misc_feature (741)..(741): n is a, c, g, or t
tacggctaggtacgaggctggtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttcnaatnntcntnagcntttaantaaacacaaaccagacgaaaaaaaaaaggggggtaaatacccgggggcaagtgggcccgtttggaagggcccaaggggggtaaagaaggggggggtaaaaggggggaagggggttgggagccttgggggtgggaccaagaagggggaaaaaggttggaaggtggggaggtaa

SEQ ID NO: 334939 - DNA, 1293 bp, Homo sapiens
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagggcgcaatgccaggatctccctgcaacatccaccgtcagggctcaagtggtctttccacctcagcttcctgggactgcaggcacgtgctaccaccacgcctggctaatttttagtttttttacagaagcgggcttttgccatgttgtccaggctggtctctactcctgggctcaagcagtcctcctgcctcagtctcccaaagtgctggaattacagggaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 334940 - DNA, 1233 bp, Homo sapiens
  misc_feature (1041)..(1041): n is a, c, g, or t
  misc_feature (1045)..(1046): n is a, c, g, or t
  misc_feature (1049)..(1049): n is a, c, g, or t
  misc_feature (1051)..(1051): n is a, c, g, or t
  misc_feature (1055)..(1055): n is a, c, g, or t
  misc_feature (1061)..(1061): n is a, c, g, or t
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttcnaatnntcntnagcntttaantaaacacaaaccagacgaaaaaaaaaaggggggtaaatacccgggggcaagtgggcccgtttggaagggcccaaggggggtaaagaaggggggggtaaaaggggggaagggggttgggagccttgggggtgggaccaagaagggggaaaaaggttggaaggtggggaggtaa

SEQ ID NO: 334941 - DNA, 1102 bp, Homo sapiens
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaaaagaagacgtggtttggtctcagaacaa

SEQ ID NO: 334942 - DNA, 1049 bp, Homo sapiens
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtaatcccaactactcgggaggctgaggcaggagaatggctttgaaccagggagtccaaggttgcagtgagccgagatcgtgccactgcacttccagcctggcgacag

SEQ ID NO: 334943 - DNA, 1866 bp, Homo sapiens
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaagcgggcttttgccatgttgtccaggctggtctctactcctgggctcaagcagtcctcctgcctcagtctcccaaagtgctggaattacagggaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaaaaaaaaacaaaaaaaaaaaaaaaaaaaaaaaaaaaaaaaaaaaaaaaaaaaaaaaaaaatggtgggggggggtgggcccgggagaagttttaaaaaccaatatgtgggggggagaggggcacccagatgagatagaagaaaacggcgcaacaagggttcccaaagagaaacccgggcagagaaaagcgcggaggctttccacaaaataaaaacgcgccgggacacacacgagctgtgtttgagcaaaacaccacaacgggagcgctctagcagggccaaaacaggggggaccacaacacaaggaagcaaaagggagcgagaaaataatcggccagccgacgtggtgtgcgcaaccacaaacgcgcacccaaaagcacgaagaaagagctaaaaacagcgagaacagaagcaaaacgacagcgtgcgaagaaaggagaagaagaggagcgggggagagacaaagaagacgcgggaggaggcagaggacacaacggaggggggagcgggaggaggaagcgagagacagaacggacaggccggacggcagccgcaaaagagcaccagacacgagggagagcggggctgaggcggagggagaagcaggacaggagagaaggcaggcgcgaggacgagaacaacagacgacgagtggggaggggagcagaggagaggcgcgcggggcgagaagacagaacgat

SEQ ID NO: 334944 - DNA, 852 bp, Homo sapiens
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtagggctagtcggggactgtcgggctagtcggggactgtcgggcttgtcggggactgtcgggctagtcgggacgtcgggctagtcggg

SEQ ID NO: 334945 - DNA, 658 bp, Homo sapiens
  misc_feature (632)..(632): n is a, c, g, or t
agggtcattaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactagttgtaggccattcaangcctccgggccattcaacgcctccag

SEQ ID NO: 334946 - DNA, 407 bp, Homo sapiens
  misc_feature (42)..(43): n is a, c, g, or t
tgtgtaggaggaagacggtgggaggctgagctagaaatcacnnacctacgctttttgtggctcccaaactgcagagtcaatccccctggggtccctgcccctgccagcaagggtgggggtgtgatttctagctcagcgtttcccactcagctttgtgctcagatcccaggtcccaaggagtgacaggggcttcctcccaccttctgtccttgtccagtcatgtaaataatgtgctatttctctccccgagtctttttttttaaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggt

SEQ ID NO: 334947 - DNA, 185 bp, Homo sapiens
gactagttctagatcgcgagcggcgccctctttttttttaaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggt

SEQ ID NO: 334948 - DNA, 3918 bp, Homo sapiens
ggcagtgcatagctctggcacgcgctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccggcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccgtcagggagggtggctggccccatccccactgccacccagccccacccactgttggaagagggaccagcgcgaggtggtgcccagggtgggcactgctgcttaatgcgaggcacacctggggcagctgagccccccgaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggagggggtattgggtaggaccatccaagaaagggcagaagaccaagggcagtcggggtctagaaaggagggcgctggccctgctgggcgcttcggagcccccactgtttcccactcagctttgtgctcagatcccaggtcccaaggagtgacaggggcttcctcccaccttctgtccttgtccagtcatgtaaataatgtgctatttctctccccgagtctttttttttaaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggt

SEQ ID NO: 334949 - DNA, 4037 bp, Homo sapiens
agatgctgctggcggaacctgcaggagctagcgggattcgggggcgctaaagtcgcaggggcagggcgggaaggaagatccggcgcggggcacaggatccggagctggagcccccagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccggcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccgtcagggagggtggctggccccatccccactgccacccagccccacccactgttggaagagggaccagcgcgaggtggtgcccagggtgggcactgctgcttaatgcgaggcacacctggggcagctgagccccccgaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggagggggtattgggtaggaccatccaagaaagggcagaagaccaagggcagtcggggtctagaaaggagggcgctggccctgctgggcgcttcggagcccccactgtttcccactcagctttgtgctcagatcccaggtcccaaggagtgacaggggcttcctcccaccttctgtccttgtccagtcatgtaaataatgtgctatttctctccccgagtctttttttttaaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggttttaaaaaaatattacttataaaaaaggtttaatatattatataaatatttttttgggggggaccctgtgggagttattcctcttggggggggcttggaccataacagccctatttaaatattcttcggggggggcccgggcccttacccc

SEQ ID NO: 334950 - DNA, 3844 bp, Homo sapiens
agatgctgctggcggaacctgcaggagctagcgggattcgggggcgctaaagtcgcaggggcagggcgggaaggaagatccggcgcggggcacaggatccggagctggagcccccagaattttcccactgtaaaaaaccgagcaagtctggataagtgaggctggctccatgtatccagaatcaacgacgggctccccggctcggctctcgctgcggcagacgggctcccccgggatgatctacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccggcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccgtcagggagggtggctggccccatccccactgccacccagccccacccactgttggaagagggaccagcgcgaggtggtgcccagggtgggcactgctgcttaatgcgaggcacacctggggcagctgagccccccgaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggagggggtattgggtaggaccatccaagaaagggcagaagaccaagggcagtcggggtctagaaaggagggcgctggccctgctgggcgcttcggagcccccactgtttcccactcagctttgtgctcagatcccaggtcccaaggagtgacaggggcttcctcccaccttctgtccttgtccagtcatgtaaataatgtgctatttctctccccgagtctttttttttaaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggt

SEQ ID NO: 334951 - DNA, 3508 bp, Homo sapiens
tcaccggtgcctttaccaggtgagtgccgcaggcagcccatttttcagatgtggacactgtggcacagagaggttcagtaacatgccaaggtcacacagcttgggccaagattaacatccaggctgtgtggttcagagcctgggctgctcataactggaccctccggcctgggggtcccaccacccacctccttttcccagctcaccagggcctgcctggctcccagggaagctatgagtgtgagcagtggggagcccgggctgcagctgctgggccagcctgctccggggacaccttggtgccctctccatggctgccccggcagcctcccgcctgctcacaggcaagggccctcggggtccctttctgccttcacaggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccggcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccgtcagggagggtggctggccccatccccactgccacccagccccacccactgttggaagagggaccagcgcgaggtggtgcccagggtgggcactgctgcttaatgcgaggcacacctggggcagctgagccccccgaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggagggggtattgggtaggaccatccaagaaagggcagaagaccaagggcagtcggggtctagaaaggagggcgctggccctgctgggcgcttcggagcccccactgtttcccactcagctttgtgctcagatcccaggtcccaaggagtgacaggggcttcctcccaccttctgtccttgtccagtcatgtaaataatgtgctatttctctccccgagtctttttttttaaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggt

SEQ ID NO: 334952 - DNA, 1836 bp, Homo sapiens
acagacgtccaccaaagccacacatcgcgacacacggaggcagaaagcagcggtctcctaagaagttagacacgaggaatctcgggcagcgagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccgtcagggagggtggctggccccatccccactgccacccagccccacccactgttggaagagggaccagcgcgaggtggtgcccagggtgggcactgctgcttaatgcgaggcacacctggggcagctgagccccccgaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggagggggtattgggtaggaccatccaagaaagggcagaagaccaagggcagtcggggtctagaaaggagggcgctggccctgctgggcgcttcggagcccccactgtttcccactcagctttgtgctcagatcccaggtcccaaggagtgacaggggcttcctcccaccttctgtccttgtccagtcatgtaaataatgtgctatttctctccccgagtctttttttttaaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggt

SEQ ID NO: 334953 - DNA, 954 bp, Homo sapiens
ggcagtgcatagctctggcacgcgctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtttcccactcagctttgtgctcagatcccaggtcccaaggagtgacaggggcttcctcccaccttctgtccttgtccagtcatgtaaataatgtgctatttctctccccgagtctttttttttaaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggt

SEQ ID NO: 334954 - DNA, 1109 bp, Homo sapiens
ggcagtgcatagctctggcacgcgctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggatcttcgcggcgtctcagcctctccggagctcactgttcccatctgtaagagggtgtgtgtgggaccgttccggcagggctatcctgagggtcagtggccccaagtctgtaaatcacccacccagctcagggcgggacgtgtcacactcctctgggaagtggtcccctccagcacagaccggggagcggtccccgggtgtgatggagcccaaaggtcgcagatcgggggccatccacccttctctcccaggagcctatgggcccttcccaggccaaggtcctcacccaccttgggaccaactgggctgagcacttgcctacattttgaggctccccagacccctggacacagctttatctcaaggtgctgacaagccccggggccctgttccttaataaatgcgtctttattttcagaaacatcagaagcagttataaagttgggcctccctcctccctcccctcgaaatgccactcagaatcccagtgccaaggggagcccccgccccctcccccatggattcctgacaccccttcctcttgtcccatcaaatttgttttttggcaactctgatcccaaaacaaattcctcctcaccctgtaattaaacgaaattgcacgta

SEQ ID NO: 334955 - DNA, 3886 bp, Homo sapiens
agatgctgctggcggaacctgcaggagctagcgggattcgggggcgctaaagtcgcaggggcagggcgggaaggaagatccggcgcggggcacaggatccggagctggagcccccagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccggcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccgtcagggagggtggctggccccatccccactgccacccagccccacccactgttggaagagggaccagcgcgaggtggtgcccagggtgggcactgctgcttaatgcgaggcacacctggggcagctgagccccccgaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggagggggtattgggtaggaccatccaagaaagggcagaagaccaagggcagtcggggtctagaaaggagggcgctggccctgctgggcgcttcggagcccccactgtttcccactcagctttgtgctcagatcccaggtcccaaggagtgacaggggcttcctcccaccttctgtccttgtccagtcatgtaaataatgtgctatttctctccccgagtctttttttttaaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggt

SEQ ID NO: 334956 - DNA, 3930 bp, Homo sapiens
  misc_feature (35)..(35): n is a, c, g, or t
  misc_feature (47)..(47): n is a, c, g, or t
  misc_feature (50)..(50): n is a, c, g, or t
  misc_feature (62)..(62): n is a, c, g, or t
tcacacacaatcgggactatggactaccaaagttntggatccacaanaangcagcgcgtttnttatataacggaccgcatacaacgtctagtacgagctggtggaatcgcaggcgtaagtcgaggcagcggagagacgcgcggcaagatcggagtgagcccaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccggcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccgtcagggagggtggctggccccatccccactgccacccagccccacccactgttggaagagggaccagcgcgaggtggtgcccagggtgggcactgctgcttaatgcgaggcacacctggggcagctgagccccccgaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggagggggtattgggtaggaccatccaagaaagggcagaagaccaagggcagtcggggtctagaaaggagggcgctggccctgctgggcgcttcggagcccccactgtttcccactcagctttgtgctcagatcccaggtcccaaggagtgacaggggcttcctcccaccttctgtccttgtccagtcatgtaaataatgtgctatttctctccccgagtctttttttttaaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggt

SEQ ID NO: 334957 - DNA, 3876 bp, Homo sapiens
ggcagtgcatagctctggcacgcgctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccggcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccgtcagggagggtggctggccccatccccactgccacccagccccacccactgttggaagagggaccagcgcgaggtggtgcccagggtgggcactgctgcttaatgcgaggcacacctggggcagctgagccccccgaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggagggggtattgggtaggaccatccaagaaagggcagaagaccaagggcagtcggggtctagaaaggagggcgctggccctgctgggcgcttcggagcccccactgtttcccactcagctttgtgctcagatcccaggtcccaaggagtgacaggggcttcctcccaccttctgtccttgtccagtcatgtaaataatgtgctatttctctccccgagtctttttttttaaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggt

SEQ ID NO: 334958 - DNA, 3279 bp, Homo sapiens
ccctagggccaggaggttcttctgggccacgggtggcagccgagaccccaggctgccaagtttcctaagagaaggaaggccagcacctcgcctccttgtcctgacttggggttgggccagcaccacagtctttgcacttcagagcctggacaggccccgctcatccaccagcccgtgcccggcccactgcccactctcccctacttgagaggcctggggcaggggcactgccctggcttcaagatgagaagagcccctatgagggagaagggtccagaaggaatgagcccatcggccccctgcacgtgggggtccaggtgacctgctctcatctgtagctgtgctgctcccctcccccgcaaccagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccggcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccgtcagggagggtggctggccccatccccactgccacccagccccacccactgttggaagagggaccagcgcgaggtggtgcccagggtgggcactgctgcttaatgcgaggcacacctggggcagctgagccccccgaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggagggggtattgggtaggaccatccaagaaagggcagaagaccaagggcagtcggggtctagaaaggagggcgctggccctgctgggcgcttcggagcccccactgtttcccactcagctttgtgctcagatcccaggtcccaaggagtgacaggggcttcctcccaccttctgtccttgtccagtcatgtaaataatgtgctatttctctccccgagtctttttttttaaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggt

SEQ ID NO: 334959 - DNA, 1850 bp, Homo sapiens
ggcagtgcatagctctggcacgcgctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtttcccactcagctttgtgctcagatcccaggtcccaaggagtgacaggggcttcctcccaccttctgtccttgtccagtcatgtaaataatgtgctatttctctccccgagtctttttttttaaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggt

SEQ ID NO: 334960 - DNA, 745 bp, Homo sapiens
ggcagtgcatagctctggcacgcgctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggatcttcgcggcgtctcagcctctccggagctcactgttcccatctgtaagaggaaacatcagaagcagttataaagttgggcctccctcctccctcccctcgaaatgccactcagaatcccagtgccaaggggagcccccgccccctcccccatggattcctgacaccccttcctcttgtcccatcaaatttgttttttggcaactctgatcccaaaacaaattcctcctcaccctgtaattaaacgaaattgcacgta

SEQ ID NO: 334961 - DNA, 633 bp, Homo sapiens
ccattccagaagaagatgattttggtgatgttctgtgggacatacatgatgaacaagagcaaatggaaacttttcagcaggcttctaattcagcccatgagttgggatttgagaaatattaccaacgccttaatgatctagtggcagcaccagccccgattccacctcttctcgtgtctggaggaccaggttctgggaagtctcttcttttatcaaagtggattcaattacaacagaagaattcccccaacacactgattctttcccattttgtgggaaggcccatgtcaaccagctcagagtcctccttgattattaaacgactaactctaaagttgatgcagcactcttggtcagtctctgctctgacactggatcctgctaagcttctggaagaatttccacgttggctggaaaaactctctgctcgtcatcaaggcagcatcatcatcgttattgattctatagatcaagttcaggttgtggcctacacttcatcttgatcccttaagtccaaaagatgcaaaatctattataattgcagaatgccactctgtagacattaaattgagtaaagagcagtctctcatctttcctatgaaacatcttatgtgagacttaaaattcaatata

SEQ ID NO: 334962 - DNA, 814 bp, Homo sapiens
ccattccagaagaagatgattttggtgatgttctgtgggacatacatgatgaacaagagcaaatggaaacttttcagcaggcttctaattcagcccatgagttgggatttgagaaatattaccaacgccttaatgatctagtggcagcaccagccccgattccacctcttctcgtgtctggaggaccaggttctgggaagtctcttcttttatcaaagtggattcaattacaacagaagaattcccccaacacactgattctttcccattttgtgggaaggcccatgtcaaccagctcagagtcctccttgattattaaacgactaactctaaagttgatgcagcactcttggtcagtctctgctctgacactggatcctgctaagcttctggaagaatttccacgttggctggaaaaactctctgctcgtcatcaaggcagcatcatcatcgttattgattctatagatcaagttcagcaagttgaaaaacacatgaaatggctgatagatccactgccagtgaatgtaagagtaattgtttctgtgaatgtagaaacatgccctccagcatggaggttgtggcctacacttcatcttgatcccttaagtccaaaagatgcaaaatctattataattgcagaatgccactctgtagacattaaattgagtaaagagcaggagaagaagctagaacgacactgtcgttctgctacaacctgcaatgccctttatgtcacccttttcggcaaaatgatcgcgcgtgctgggagagcaggcaatttagataaaatccttcatcagtgtttccagtg

SEQ ID NO: 334963 - DNA, 1264 bp, Homo sapiens
ccattccagaagaagatgattttggtgatgttctgtgggacatacatgatgaacaagagcaaatggaaacttttcagcaggcttctaattcagcccatgagttgggatttgagaaatattaccaacgccttaatgatctagtggcagcaccagccccgattccacctcttctcgtgtctggaggaccaggttctgggaagtctcttcttttatcaaagtggattcaattacaacagaagaattcccccaacacactgattctttcccattttgtgggaaggcccatgtcaaccagctcagagtcctccttgattattaaacgactaactctaaagttgatgcagcactcttggtcagtctctgctctgacactggatcctgctaagcttctggaagaatttccacgttggctggaaaaactctctgctcgtcatcaaggcagcatcatcatcgttattgattctatagatcaagttcaggttgtggcctacacttcatcttgatcccttaagtccaaaagatgcaaaatctattataattgcagaatgccactctgtagacattaaattgagtaaagagcaggagaagaagctagaacgacactgtcgttctgctacaacctgcaatgccctttatgtcacccttttcggcaaaatgatcgcgcggtgagtggtgattattttacatgatcttctgcatgttttgtgtttgctgcagaccctttctcaccctgcaaaactgagaactgatcactacaccagtctgttgagccactcagattttatttgaatagtgatactaacatttgtgagaacatggcttacaggtgcctactgtccatgattgtcagaacttgatagatttgtctaattttcttcacactaatctgttccctattggaggttgcaaaagaaagccatcctcaccctcatttgtggcccctagctttgggaaagtgaaggaaacaactgagggttacaatattatttcaggtatctttgaatatcaggaggtagatatatggatatgaatttttaattgtctctgttctcaagtcctgataaactttttaattataaaaatagttctattttagatatccattagtaatctgcctttagataagcattagagtatcactacttttatttcctcagtatagctttaccctattctatctattctcaaccgttagaatgttttactacttttatttcttcttcagtatagcatcactctactttgtcttttctcaatctgaggt

SEQ ID NO: 334964 - DNA, 614 bp, Homo sapiens
ccattccagaagaagatgattttggtgatgttctgtgggacatacatgatgaacaagagcaaatggaaacttttcagcaggcttctaattcagcccatgagttgggatttgagaaatattaccaacgccttaatgatctagtggcagcaccagccccgattccacctcttctcgtgtctggaggaccaggttctgggaagtctcttcttttatcaaagtggattcaattacaacagaagaattcccccaacacactgattctttcccattttgtgggaaggcccatgtcaaccagctcagagtcctccttgattattaaacgactaactctaaagttgatgcagcactcttggtcagtctctgctctgacactggatcctgctaagcttctggaagaatttccacgttggctggaaaaactctctgctcgtcatcaaggcagcatcatcatcgttattgattctatagatcaagttcaggttgtggcctacacttcatcttgatcccttaagtccaaaagatgcgagcaggtgtgtatttttcattttgatgcaatcttttactctctcatctttcctatgaaacatcttatgtgagacttaaaattcaatata

SEQ ID NO: 334965 - DNA, 2170 bp, Homo sapiens
gacgcagatgtgaagggcgctgctctcaggagcagacagaggtggggatgaatcagtacacgcccacctcgggcccacaggggaggatgcgcggagctgtgggtgtggggaggagacccctctgcgtcatgctgacggtgtcggcagagtcgccagcttctgcaggagcggtacctgtgggttcttctgtgacttgtttaaccgcatcttttgcccagtagttagtcttttcctgttgggacaccatgttggtagtttggaaatggtttcttccatccattgcctgccttttagctttgtcgatggtgttctgttgtaaattttggtgcacgtttaatgtgaacaatggttatgagacgagtgccatgagttcctgtgtgcctgtcacccagcccggccacaagaggtgctgggggcagtgtccacacccccctttcttaggacgcctgagtctcagatgtgacttatagggtatttcttatggcaagacagttaaaacaaacttcagcgtctcgtctgtccttctatggctgtggcttctgatgttctaatggcgttctcgtcagccggggctgaggaacaaaataacatagactgtggggcttaaacagcagaaacttacttcccatggttctggaggttgggagtcttggatcaccgtgtagcatggtcaggttcctggtgagggtgggattcctgggctaacgtaacgaaggctccctctcctgataccgtgtcactgggggtgaggcttcaacacaggaattttggggggacacatcagcattcactccatcacaggtggttagccctttaatccacgggaattttgtttggggttgtgtgagatacgggtctaacgttttctttttcaaatacgtagccagttgtcacatcatttattgaaaaaggaatcttttctccaccgactgacatgaaatgctaccatcatcgtaaataaaattcccgtaaatacttgctgtctctgctgtctcagtcctgactcacgggctgagttctctttctgcacagtagcactggcattaactgtgacagctttacagcaggctccctccccgaggccgttcagaagcattcctcagcgggtcctacacgtttcctctcccatgtcaagtttagaagcagtgtcaagacccacagcagtcctgcgggagttttaagggatgcacggagtttatggggacagtttggaaaattgacattcatgtgacttagagtcctactacttgaaaatggattccagctctcaacgaatttagagctttggcaaaatttttaagatttctttgatgtccgatgtgctcatttcttggtttgttcttgagtattttgtggatttttatgaaatccacaaagtttttgttataatgaatgggacactttcccataaaatgttgtaattctgtattgctgttttagtaaacactgttgattgatgtatattgatgttacacttggtcacttgtaatagtttgtccgttcattattttgaactttttaggtaaacagtcatataattatgcaaataattatagttgtgtctctgcctttctaatatttatactttgtgtatattatcatgttggccaggactcaagcgtctttctcttgtttctgactaatgcgaatgattctaatgcaggggtttccaaactggtggccggggggccaaatccagccaatggtctcttcttgtaaataaagttttattggaacacagttacacacatttttctacatattgtctgatggctactgtcacgccacagcaatggtgttaaatagtccagacagaggcggtattgcccgaaaaacctagaatattcaccatctgagcttttacgggaaaatttgctaatatctgttctcatgcattaaatacaatgtttgttacaggttaaggaagtttctgactatttttagctttctgaatatcttgtggttgtgtgtgctttaaaattaggactaaatattaaatttaccagttgcttgttaggggcctatcttttgagatgcccaaagtttcccttttttagtctcttcatgtagtgagttgtactaacagaaggtttttccaggcacgatactgtcctgggtcgaacgagggcagtgtattcgcaattaaggtaatagacagcctcagggcgtt

SEQ ID NO: 334966 - DNA, 655 bp, Homo sapiens
tgagctcaacccattgagctcttcgtgttcgaattcatggactctcatctgttcctatctccttctctttatgaaatgactaatgcgaatgattctaatgcaggggtttccaaactggtggccggggggccaaatccagccaatggtctcttcttgtaaataaagttttattggaacacagttacacacatttttctacatattgtctgatggctactgtcacgccacagcaatggtgttaaatagtccagacagaggcggtattgcccgaaaaacctagaatattcaccatctgagcttttacgggaaaatttgctaatatctgttctcatgcattaaatacaatgtttgttacaggttaaggaagtttctgactatttttagctttctgaatatcttgtggttgtgtgtgctttaaaattaggactaaatattaaatttaccagttgcttgttaggggcctatcttttgagatgcccaaagtttcccttttttagtctcttcatgtagtgagttgtactaacagattctctaatgttgaaccgtctttgctttccggagatagactttacttgctcctggtggattggattctgtttgttaatacttttatttttgggtaattacatccctattataaataatatgtcagcat

SEQ ID NO: 334967 - DNA, 1740 bp, Homo sapiens
gacgcagatgtgaagggcgctgctctcaggagcagacagaggtggggatgaatcagtacacgcccacctcgggcccacaggggaggatgcgcggagctgtgggtgtggggaggagacccctctgcgtcatgctgacggtgtcggcagagtcgccagcttctgcaggagcggtacctgtgggttcttctgtgacttgtttaaccgcatcttttgcccagtagttagtcttttcctgttgggacaccatgttggtagtttggaaatggtttcttccatccattgcctgccttttagctttgtcgatggtgttctgttgtaaattttggtgcacgtttaatgtgaacaatggttatgagacgagtgccatgagttcctgtgtgcctgtcacccagcccggccacaagaggtgctgggggcagtgtccacacccccctttcttaggacgcctgagtctcagatgtgacttatagggtatttcttatggcaagacagttaaaacaaacttcagcgtctcgtctgtccttctatggctgtggcttctgatgttctaatggcgttctcgtcagccggggctgaggaacaaaataacatagactgtggggcttaaacagcagaaacttacttcccatggttctggaggttgggagtcttggatcaccgtgtagcatggtcaggttcctggtgagggtgggattcctgggctaacgtaacgaaggctccctctcctgataccgtgtcactgggggtgaggcttcaacacaggaattttggggggacacatcagcattcactccatcacaggtggttagccctttaatccacgggaattttgtttggggttgtgtgagatacgggtctaacgttttctttttcaaatacgtagccagttgtcacatcatttattgaaaaaggaatcttttctccaccgactgacatgaaatgctaccatcatcgtaaataaaattcccgtaaatacttgctgtctctgctgtctcagtcctgactcacgggctgagttctctttctgcacagtagcactggcattaactgtgacagctttacagcaggctccctccccgaggccgttcagaagcattcctcagcgggtcctacacgtttcctctcccatgtcaagtttagaagcagtgtcaagacccacagcagtcctgcgggagttttaagggatgcacggagtttatggggacagtttggaaaattgacattcatgtgacttagagtcctactacttgaaaatggattccagctctcaacgaatttagagctttggcaaaatttttaagatttctttgatgtccgatgtgctcatttcttggtttgttcttgagtattttgtggatttttatgaaatccacaaagtttttgttataatgaatgggacactttcccataaaatgttgtaattctgtattgctgttttagtaaacactgttgattgatgtatattgatgttacacttggtcacttgtaatagtttgtccgttcattattttgaactttttaggtaaacagtcatataattatgcaaataattatagttgtgtctctgcctttctaatatttatactttgtgtatattatcatgttggccaggactcaagcgtctttctcttgtttctgactaatgcgaatgattctaatgcaggggtttccaaactggtggccggggggccaaatccagccaatggtctcttcttgtaaataaagttttattggaacaca

SEQ ID NO: 334968 - DNA, 2215 bp, Homo sapiens
gacgcagatgtgaagggcgctgctctcaggagcagacagaggtggggatgaatcagtacacgcccacctcgggcccacaggggaggatgcgcggagctgtgggtgtggggaggagacccctctgcgtcatgctgacggtgtcggcagagtcgccagcttctgcaggagcggtacctgtgggttcttctgtgacttgtttaaccgcatcttttgcccagtagttagtcttttcctgttgggacaccatgttggtagtttggaaatggtttcttccatccattgcctgccttttagctttgtcgatggtgttctgttgtaaattttggtgcacgtttaatgtgaacaatggttatgagacgagtgccatgagttcctgtgtgcctgtcacccagcccggccacaagaggtgctgggggcagtgtccacacccccctttcttaggacgcctgagtctcagatgtgacttatagggtatttcttatggcaagacagttaaaacaaacttcagcgtctcgtctgtccttctatggctgtggcttctgatgttctaatggcgttctcgtcagccggggctgaggaacaaaataacatagactgtggggcttaaacagcagaaacttacttcccatggttctggaggttgggagtcttggatcaccgtgtagcatggtcaggttcctggtgagggtgggattcctgggctaacgtaacgaaggctccctctcctgataccgtgtcactgggggtgaggcttcaacacaggaattttggggggacacatcagcattcactccatcacaggtggttagccctttaatccacgggaattttgtttggggttgtgtgagatacgggtctaacgttttctttttcaaatacgtagccagttgtcacatcatttattgaaaaaggaatcttttctccaccgactgacatgaaatgctaccatcatcgtaaataaaattcccgtaaatacttgctgtctctgctgtctcagtcctgactcacgggctgagttctctttctgcacagtagcactggcattaactgtgacagctttacagcaggctccctccccgaggccgttcagaagcattcctcagcgggtcctacacgtttcctctcccatgtcaagtttagaagcagtgtcaagacccacagcagtcctgcgggagttttaagggatgcacggagtttatggggacagtttggaaaattgacattcatgtgacttagagtcctactacttgaaaatggattccagctctcaacgaatttagagctttggcaaaatttttaagatttctttgatgtccgatgtgctcatttcttggtttgttcttgagtattttgtggatttttatgaaatccacaaagtttttgttataatgaatgggacactttcccataaaatgttgtaattctgtattgctgttttagtaaacactgttgattgatgtatattgatgttacacttggtcacttgtaatagtttgtccgttcattattttgaactttttaggtaaacagtcatataattatgcaaataattatagttgtgtctctgcctttctaatatttatactttgtgtatattatcatgttggccaggactcaagcgtctttctcttgtttctgactaatgcgaatgattctaatgcaggggtttccaaactggtggccggggggccaaatccagccaatggtctcttcttgtaaataaagttttattggaacacagttacacacatttttctacatattgtctgatggctactgtcacgccacagcaatggtgttaaatagtccagacagaggcggtattgcccgaaaaacctagaatattcaccatctgagcttttacgggaaaatttgctaatatctgttctcatgcattaaatacaatgtttgttacaggttaaggaagtttctgactatttttagctttctgaatatcttgtggttgtgtgtgctttaaaattaggactaaatattaaatttaccagttgcttgttaggggcctatcttttgagatgcccaaagtttcccttttttagtctcttcatgtagtgagttgtactaacagattctctaatgttgaaccgtctttgctttccggagatagactttacttgctcctggtggattggattctgtttgttaatacttttatttttgggtaattacatccctattataaataatatgtcagcat

SEQ ID NO: 334969 - DNA, 1389 bp, Homo sapiens
agcagggtcggcagtgaagagcagagaaaggcagttggggatgttgccactgtcccccgagaccaccctgccatggagacgagggagctgtcccttcgcggaagggggctggccagcaagaaggacagagagtggactggccgaggaccgctgagctcaggacccaaggaggactcttctaggagacgagagagcgaacgccagggaccctgtgcaggcctgctcctccgtttgcaagcaggctccctccccgaggccgttcagaagcattcctcagcgggtcctacacgtttcctctcccatgtcaagtttagaagcagtgtcaagacccacagcagtcctgcgggagttttaagggatgcacggagtttatggggacagtttggaaaattgacattcatgtgacttagagtcctactacttgaaaatggattccagctctcaacgaatttagagctttggcaaaatttttaagatttctttgatgtccgatgtgctcatttcttggtttgttcttgagtattttgtggatttttatgaaatccacaaagtttttgttataatgaatgggacactttcccataaaatgttgtaattctgtattgctgttttagtaaacactgttgattgatgtatattgatgttacacttggtcacttgtaatagtttgtccgttcattattttgaactttttaggtaaacagtcatataattatgcaaataattatagttgtgtctctgcctttctaatatttatactttgtgtatattatcatgttggccaggactcaagcgtctttctcttgtttctgactaatgcgaatgattctaatgcaggggtttccaaactggtggccggggggccaaatccagccaatggtctcttcttgtaaataaagttttattggaacacagttacacacatttttctacatattgtctgatggctactgtcacgccacagcaatggtgttaaatagtccagacagaggcggtattgcccgaaaaacctagaatattcaccatctgagcttttacgggaaaatttgctaatatctgttctcatgcattaaatacaatgtttgttacaggttaaggaagtttctgactatttttagctttctgaatatcttgtggttgtgtgtgctttaaaattaggactaaatattaaatttaccagttgcttgttaggggcctatcttttgagatgcccaaagtttcccttttttagtctcttcatgtagtgagttgtactaacagattctctaatgttgaaccgtctttgctttccggagatagactttacttgctcctggtggattggattctgtttgttaatacttttatttttgggtaattacatccctattataaataatatgtcagcat

SEQ ID NO: 334970 - DNA, 141 bp, Homo sapiens
tctgagcactagtttaaactcctggtcccacatcggtgcagacctaggcataataatcactgttccatggatgaagggctgtttctttgagacggagtcttgctctgtcatccaggctggagtgcagtggtgtgatctcgg

SEQ ID NO: 334971 - DNA, 310 bp, Homo sapiens
gcggaggttgcagtgagccacaagatctggccaccgcactccaacctgggtgacagagtgagattatctcaaaaaaacaaaaaaaaaaaaacaaaaaaaaaaaaagagaaaaagaaagaaaagaaataaaggatattcacagttataaaagtgtagatagtgaaactagaaatgatttttcttgtactttcctgtatttttcaagttttctgtagaaaaaacttttaaaaaaggatgcaagtattaacagcactttgagagtttctatatcatttttttcactttctagtggaaagccccacccttatgc

SEQ ID NO: 334972 - DNA, 491 bp, Homo sapiens
gcactgttgtatgcaatgcattgacttgtctcttctgcatccagaatgattttggttctatgccatcctcaggagagttgagaagtcactcccatcagcttctgtgttctgcagagtagcactgcactgggaaaggctgcaaggttatttgtgcctgtctttccccctgatggactgtgagcctccctagggcagagaccactttctttttttgtttgtttgtttgctttgagacggagtctggctcggtcacccagggtggagtgtcgtggcgtgatcttggctcactgcaacctccgcctcccaggttcaagtgattctcctgcctcggcctcctgagtagctgggattacaggcgcgagccaccacgcctggctaatttttgtatttttagtagagacggggttttaccatgttggtcaggctggtctcgaactcctgacctcgtgatctgcccgcctaggcctcccaaagtgctgggattacaggcg

SEQ ID NO: 334973 - DNA, 219 bp, Homo sapiens
gctgaggcaggagaatggtgtgaacccaggaggcggaggttgcagtgagccgagattgcgccactacactccagcctgggtgacagagcaagactctgcctcagaaaaaaaaaaaaagatgtcaagatctcagtagtgacagtacaagcaaacacctctcattcccagcacccagcacgggccaaatcagaatttgctgatctggaaaaagagatgtac

SEQ ID NO: 334974 - DNA, 408 bp, Homo sapiens
tggaaccaattcctccaacccacagatactgagggacagctatattgttacatatatatatgaatatatatgtcagcatataaatcacatatgcttggaaatataactaaaaaaaaacttcagaggtctgataacctagaacattagaacatgtatgccccaacagctcagagaactcacatcctgggatgtacatccataaagagctcaaagatcaaacatctcatagggcatgcttttacaaatagatcagaaaattcagatcctatgttaaaaccctcaacaaaggtcaaagacttcacacagtggttcattcaccagtgaacacatcagacatttcacaccatcagacaccacccacaaacagatcagggaattaacatcctgagacatataccaacagatcag

SEQ ID NO: 334975 - DNA, 559 bp, Homo sapiens
gagaaattggaaccctattgttgatgatggtacagccactttggaaaacagtttttctgcctttcctcaaacagttaaaacatagttactatatgatccagtaatttcactcttaagtaaatactcaagagaactgaaaatgtatgtccacacagaaacttatgtgagaatgtgttcagagcatgattcataataatcaaaaagtagacataacccaaatgtccatcatctaatgaatgaataaacaatggaatattttggaatataatgtacattgtatgtacagtagaatatatacaatggagtgttattcagctataaataagagtggaatactgaatcatgttaaacagggaagaaccttgaaaacatgctaagtgaaagaaaataacaaaaggccacatatgcccagaataagtgaaaaaaagatacggaagataacgtagtagttgccagaggttgtgggaggtgaataatgggagctgtctactgtttggtatgtggtttctttttgttatgataaaagtgttctgcaattagatagtggtggtggttgcac

SEQ ID NO: 334976 - DNA, 406 bp, Homo sapiens
atgtctgctcccaaacccaagatccttatagtttcactgaagatcacccttcatctgctcccatgacctcagtccctcctgggccaagaggcagtcctgcatagtgatttggaatgtatcctgaagtcacactgcttagtttgaatcctgccctgccatgcccaagccatgtgccatagagcaactaatttaccaaggtcttgactttagctttaaaatatctgcctcaggtttgttgtgagaagtaaatgtaaagtccttaaaacagtgtctagcaagaaacacaattaatacaagtaatgttattagtcccagtgaggggaagaggaggaatcaagagtataggtgtgcctgaacttaatcaaaactgtgacttgatgacaaaaaggttgccacgcactgagcc

SEQ ID NO: 334977 - DNA, 486 bp, Homo sapiens
agaacaattaacaaacattttggaattaacctgtgtatataggtgcagacaacactctgtttattaaattcttgccttttgtgtgtgtgtgtgtgtgtgtggcttactgttgttttgttttagaatcttggggttgttcaataatagtaaataagacaaaaatgtctgtttctatcatgggcagtatcaacagtttaccatccaatgagagcatcctcctctgcttttctttttctgtcccttttaaattctattatgtctgtttctgaggaactacacagatggcaattatcatgagagtcagttgaatgttggggatactttctccattttactttacatttttttgctgtggccttgcctatactttgattatttttcttagctgctacttcttacatggctatatatgtgtgtgtgtgtgtgtgtgtgtgtgtgtgtgtgtgtgtgtgtgtgtgtattcccccatctgttcatgtgttctca

SEQ ID NO: 334978 - DNA, 587 bp, Homo sapiens
ttttcaaattatgatgtctggtgttgctttcagggtttgtgagatagtcttttgaatgctctcagtgttgactcttgaaagtagatttgattttaaaaaacaatcaagggttctgggccaaatctggtgaactaggggggcggtcaaactgtgtaatgccaagaggggtgactctaatgtatccaggctgatttttcttgagtgaatttgtagtcaccagaaggcactttctgaagacaaactcagacatgaagtaaacatgttataagcatgacatcaagcttgagtttggggaggagagttggaagatggtgactgcgctgaaggaaaccccactcatttgggtatgcaagttttctaggatctcctctacccagaatatttcttcaggtccagatctatcctatttcacaggaccacagttcccagacttacaaggatcctactgccttagtcaacttttaacccccaacctgagtacttccctcccccccgggcaaagacagggtcttgctcttttgtacagtggtgggattacagctcattgcagctttgaactcctgggctcgagtaatcctcccgcctca

SEQ ID NO: 334979 - DNA, 1670 bp, Homo sapiens
acgcgtccgaaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaaaaaaggcactaaggttgcaaaagcttctcatttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaattttaattgaactatgtgtaatttcttaattttgaaataattttatttgtaatgtgcataatcttatttaatgtataatgtatacattgtaatagaaacagatttcccaaattccagcctggcatgaggtaataaaaggtaatgcaaaggga

SEQ ID NO: 334980 - DNA, 1518 bp, Homo sapiens
acgcgtccgaaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaaaaaaggcactaaggttgcaaaagcttctcatttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaa

SEQ ID NO: 334981 - DNA, 1490 bp, Homo sapiens
cccccgggctgcaggaattcggcacagtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaaaaaaggcactaaggttgcaaaagcttctcatttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaa

SEQ ID NO: 334982 - DNA, 1402 bp, Homo sapiens
acgcgtccgaaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggttgcaaaagcttctcatttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaa

SEQ ID NO: 334983 - DNA, 1146 bp, Homo sapiens
aatgaccagcgttcatttatttttcctagtcattttgaactgcctgtagcattgatgtaatatagcctcaaacgcacacatacacacacaacactgtgctgtcactacagaaaacttttcctggcagacaggaaagggcccattgttggtaatgtcatgggtcaccagtcgtcacgccgcaccgcgtttcaaaggaagagctaacctcactgcttgtaggtagaaggaaaaaaggcactaaggttgcaaaagcttctcatttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaa

SEQ ID NO: 334984 - DNA, 2365 bp, Homo sapiens
gacaccggctcagggcggatccagccttttccgctcttccctccctccaccccctcctttccctacaactactctcaaaggaaaagggttggatgtcccatttgggtgaaaacaaagtggcataaaagcaaatgatcacctttgatagccacatattagaattttccgagggtatttttaaattacaacgattctaatgggcagctgggctgagaatcatcagatttgaaggtctggtttcacatggctcttgggctgagaagaccggattttcccccccccagcatttcctgtatgtccgagaatttcgatcctaaggttagaattgccttatgggccttggaatcctttttattcactgaccaaattgcctttgattccagctcccttggcctagggcttaatctcttcctacctccatctcttccttgtatgcttttgctcaccttgaaatgaaaagaacctggctcagcaagtgtagattctgaaatcagaaaacaggctgaataagagagatggtttattaggcactactgtgtgccaggcacatttcatgagcttccagtatgttaattcatttaatccaacaatctaagagataggttttatccttattccgaattttgagatgagcaaactaagaaacagttaaagaacttaagttgtaaggccaggaaaacagtacttataacagctgactattctataaccacacctccttaagagattattgtcagaaaaatagaaagagtaaaacatccatacataatgggtaaactttgtccacataccagaatgttactaatggctttctaacctctgaagaatttaagggaaggaggaaaggtaattttccccagggaatctacacgaagaggtaaatcttgacaatgtattaatactgtaaacccagggaaaaaaagccagtacaatttttatttagggtgtggcaaataaaacaaagggacacgtgaaaacatggctcagtaaagagctacaagacttggtgcaactgacttattgtggtgagtgagaaaaggagagagagaaaacttgaatttcaattcttctctctgggctccaataacaagattttgtattcggtctatttagtagtgaatgatacattgtgttaagttgttaacctagaggctttcatcttaagcagtacttaagatgtagaccccctcttattcaaatactgataatcagcatagaacttggcatacaagagacacttggctgttgggcattgagaaaatgttgaactgaatgaatcaatgacttaggcagccaggaagcactttgttgtagagagttggtttattactaaggaagacattaagtattaaatattagactaataggttgctaatagtgttttctctttccaatagaaaatgtcttctgaggctgatctggtgtctcacatctgtaatcccagcacttggggaggctgaggttgcaaaagcttctcatttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaa

SEQ ID NO: 334985 - DNA, 1555 bp, Homo sapiens
ctctgatacagtagccattagccacatgtgatattttaaatttaaataattaagtcaaaaattcagtttcctcagtctcaccacatttcaggttgctggtgtctactgtattggatacacagacatagaacatgtctatcatcacagaaaattctattgcattgcactgggataggtactttttgtgcccttgggctgataagttcaagtgcacttaactagcttcctccaagtggaatcagaggataaatttaccatacaaaatacaggatacccaattatatttgaatttcaaacaggcaacaaataattgcttaagtatgcccctcactgcacacccaaatattacatgagacattctatacatatatatatatatatatatatatttgaaattcagatttaactggacatttggtatttttaatgtgccaaatctagcaaccctatctgaagagcaaaactggagtgtctagtctggataggtccttttacaccacagggagttatttgaggaattgagaagggctgtggtacctgtaaagaactaactcattatgaagaaaaggatctgtaagtttttctgtatgtgtaaggaaggccaagaaggtggtttccagatatatttactttttcttctctctctcttaggttgcaaaagcttctcatttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaa

SEQ ID NO: 334986 - DNA, 993 bp, Homo sapiens
acgcgtccgaaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaaaaaaggcactaagaaaatgtcttctgaggctgatctggtgtctcacatctgtaatcccagcacttggggaggctgaggttgcaaaagcttctcatttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatatataaagaatccatccctc

SEQ ID NO: 334987 - DNA, 813 bp, Homo sapiens
acgcgtccgaaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggttgcaaaagcttctcatttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatatataaagaatccatccctc

SEQ ID NO: 334988 - DNA, 1302 bp, Homo sapiens
tgcaacctccaccccccgggtttaagcgattcttcagcctcagcctcccgagtagctgggaccacagaagcacatcaccatgcccagctaatttttgtatttttagtagagacagggtttcgccatattggccaggctggtctcaaactcccgacctcgtgattctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaattttaattgaactatgtgtaatttcttaattttgaaataattttatttgtaatgtgcataatcttatttaatgtataatgtatacattgtaatagaaacagatttcccaaattccagcctggcatgaggtaataaaaggtaatgcaaagggagaggaaagcatgtgtcattaattttctgcctaggacacctccctggttaaattgccatttcctttcttccttgcataatgattaggaaacacatcctcctgacctgcctgccctcttttgcctactttttcatctgcagtcaaggtctggttttaagactgactgttacttttacaaatctgtgtgtattggtggctaagggcctgtatgggtccactgctgtattcccagggtcccagcatggtgcctgacgctgcctggcaaatagtagtcacccgagaaatggctgatgaattcatgaggcctactctgtatggaaatttcaattctggccccgaattttcaggagctggcaagagagccaccttaatatcataggctgagttggaagaagggaacacccaacttattcttaagaagtactttgcccaggtactgtggcttaggccagtaatcctagcatttggggaagccaagttgggcagatggcttgaacccaggatttcgagatcagcctggacaacatggagaaaccccatctctacaaaatatgtaaaatttaactgcttggtgggcctgcacttctggtcccagctattccagggctagggtgggaggattgtttgatccctggaggtcaaggctgcagtgagccatgatcacagcaatgcgctccagctctgggcaacagagcgagaccctgtctcaaaaaaaacaaaaatgcctatacaataaatctataaaaagtggg

SEQ ID NO: 334989 - DNA, 2221 bp, Homo sapiens
gacaccggctcagggcggatccagccttttccgctcttccctccctccaccccctcctttccctacaactactctcaaaggaaaagggttggatgtcccatttgggtgaaaacaaagtggcataaaagcaaatgatcacctttgatagccacatattagaattttccgagggtatttttaaattacaacgattctaatgggcagctgggctgagaatcatcagatttgaaggtctggtttcacatggctcttgggctgagaagaccggattttcccccccccagcatttcctgtatgtccgagaatttcgatcctaaggttagaattgccttatgggccttggaatcctttttattcactgaccaaattgcctttgattccagctcccttggcctagggcttaatctcttcctacctccatctcttccttgtatgcttttgctcaccttgaaatgaaaagaacctggctcagcaagtgtagattctgaaatcagaaaacaggctgaataagagagatggtttattaggcactactgtgtgccaggcacatttcatgagcttccagtatgttaattcatttaatccaacaatctaagagataggttttatccttattccgaattttgagatgagcaaactaagaaacagttaaagaacttaagttgtaaggccaggaaaacagtacttataacagctgactattctataaccacacctccttaagagattattgtcagaaaaatagaaagagtaaaacatccatacataatgggtaaactttgtccacataccagaatgttactaatggctttctaacctctgaagaatttaagggaaggaggaaaggtaattttccccagggaatctacacgaagaggtaaatcttgacaatgtattaatactgtaaacccagggaaaaaaagccagtacaatttttatttagggtgtggcaaataaaacaaagggacacgtgaaaacatggctcagtaaagagctacaagacttggtgcaactgacttattgtggtgagtgagaaaaggagagagagaaaacttgaatttcaattcttctctctgggctccaataacaagattttgtattcggtctatttagtagtgaatgatacattgtgttaagttgttaacctagaggctttcatcttaagcagtacttaagatgtagaccccctcttattcaaatactgataatcagcatagaacttggcatacaagagacacttggctgttgggcattgagaaaatgttgaactgaatgaatcaatgacttaggcagccaggaagcactttgttgtagagagttggtttattactaaggaagacattaagtattaaatattagactaataggttgctaatagtgttttctctttccaatagaaaatgtcttctgaggctgatctggtgtctcacatctgtaatctcagcctctcaaatgctaggattacaggtatgagccaccgcgcccagtctgataaatctatattaaaaagaataaatataaccattgcatcttcaacagaaattggaatatggcatgtagatttcaaaataaaatgaattctctggcattgaattactgtactcatgttgaagaaatgtcagaacttcattggatgttattatattacagttgtttgtttgagttgtagtttgggcagagtaaaggagccaacatgtcttaggatttagaacttgtgcacattgcctacagttgaaagaagaaagcatgctaaattccagcctctttggtatgtggttgggacgtaaagttttaccacatccttcattgtcttagcctactcaggctgccataacaaaataccagagactggatggcttaaacaacagaatctttttttccatatctaagaggcttggaacagaaattcattttctcacagttttggagcctggaagtttaagatcaaggtgccaacatagtttatggtgagaatctgttcctggctaacagatggctgccatctcactgtgtgtttgtatggtgtttccttggtgcctgcgtggagagagagctctaagtgtctcatcttctgtaaggacaccagccccaatgggattagggccctatcctgtgatctttagttttatgtaccccctaaaggctctatgtccaaatgcagtcacactggggtttagggttttaataaatgaattttggggggacacagtttagtccataa

SEQ ID NO: 334990 - DNA, 419 bp, Homo sapiens
aatacaggatacccaattatatttgaatttcaaacaggcaacaaataattgcttaagtatgcccctcactgcacacccaaatattacatgagacattctatacatatatatatatatatatatatatatatatatatatatatatatatatatatatttgaaattcagatttaactggacatttggtatttttaatgtgccaaatctagcaaccctatctgaagagcaaaactggagtgtctagtctggataggtccttttacaccacagggagttatttgaggaattgagaagggctgtggtacctgtaaagaactaactcattatgaagaaaaggatctgtaagtttttctgtatgtgtaaggaaggccaagaaggtggtttccagatatatttactttttcttctctctctcttag

SEQ ID NO: 334991 - DNA, 384 bp, Homo sapiens
gtttattactaaggaagacattaagtattaaatattagactaataggttgctaatagtgttttctctttccaatagaaaatgtcttctgaggctgatctggtgtctcacatctgtaatcccagcacttggggaggctgaggtgggtagatcacctgaggtcaggagtttgagaccagcctggccaacatggcgaaaccccatctctaataaaactacacaaattagtcaggtgtggcggtgttcacctgtaggcgcctgtagtcccagctactcaggagactgaggcagaagaatcacttgaaccccgggaggtggaggttgtagtgagccaagatcgtgccactgcactccagcctgggcgacaaagtgaaactccgtctcaa

SEQ ID NO: 334992 - DNA, 900 bp, Homo sapiens
acgcgtccgaaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaaaaaaggcactaaggtaagttaattttatgccaaccttgagcaaagcgtattactgcttttcggtttttggggagcgctgttactaaaggttggtctgtttgtatgtaatagtaggtcagttacgtactatcatactctaaagaaatattctagttaatgctttgtaagatcgaccatagttagtgcctaacagtttacatgcagggatgcctcgtgatctaaacacttcgttgtgattactttaaaaatgtaaattgaaggcaaaactctaacgtgttggtaaccttgtttggtcctcc

SEQ ID NO: 334993 - DNA, 2421 bp, Homo sapiens
acgcgtccgaaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaaaaaaggcactaaggttgcaaaagcttctcatttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaattttaattgaactatgtgtaatttcttaattttgaaataattttatttgtaatgtgcataatcttatttaatgtataatgtatacattgtaatagaaacagatttcccaaattccagcctggcatgaggtaataaaaggtaatgcaaagggagaggaaagcatgtgtcattaattttctgcctaggacacctccctggttaaattgccatttcctttcttccttgcataatgattaggaaacacatcctcctgacctgcctgccctcttttgcctactttttcatctgcagtcaaggtctggttttaagactgactgttacttttacaaatctgtgtgtattggtggctaagggcctgtatgggtccactgctgtattcccagggtcccagcatggtgcctgacgctgcctggcaaatagtagtcacccgagaaatggctgatgaattcatgaggcctactctgtatggaaatttcaattctggccccgaattttcaggagctggcaagagagccaccttaatatcataggctgagttggaagaagggaacacccaacttattcttaagaagtactttgcccaggtactgtggcttaggccagtaatcctagcatttggggaagccaagttgggcagatggcttgaacccaggatttcgagatcagcctggacaacatggagaaaccccatctctacaaaatatgtaaaatttaactgcttggtgggcctgcacttctggtcccagctattccagggctagggtgggaggattgtttgatccctggaggtcaaggctgcagtgagccatgatcacagcaatgcgctccagctctgggcaacagagcgagaccctgtctcaaaaaaaacaaaaatgcctatacaataaatctataaaaagtggg

SEQ ID NO: 334994 - DNA, 1582 bp, Homo sapiens
acgcgtccgaaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaaaaaaggcactaagaaaatgtcttctgaggctgatctggtgtctcacatctgtaatcccagcacttggggaggctgaggttgcaaaagcttctcatttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaa

SEQ ID NO: 334995 - DNA, 1438 bp, Homo sapiens
cccccgggctgcaggaattcggcacagtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacagaaaatgtcttctgaggctgatctggtgtctcacatctgtaatcccagcacttggggaggctgaggttgcaaaagcttctcatttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaa

SEQ ID NO: 334996 - DNA, 1438 bp, Homo sapiens
acgcgtccgaaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaaaaaaggcactaagaaaatgtcttctgaggctgatctggtgtctcacatctgtaatctcagcctctcaaatgctaggattacaggtatgagccaccgcgcccagtctgataaatctatattaaaaagaataaatataaccattgcatcttcaacagaaattggaatatggcatgtagatttcaaaataaaatgaattctctggcattgaattactgtactcatgttgaagaaatgtcagaacttcattggatgttattatattacagttgtttgtttgagttgtagtttgggcagagtaaaggagccaacatgtcttaggatttagaacttgtgcacattgcctacagttgaaagaagaaagcatgctaaattccagcctctttggtatgtggttgggacgtaaagttttaccacatccttcattgtcttagcctactcaggctgccataacaaaataccagagactggatggcttaaacaacagaatctttttttccatatctaagaggcttggaacagaaattcattttctcacagttttggagcctggaagtttaagatcaaggtgccaacatagtttatggtgagaatctgttcctggctaacagatggctgccatctcactgtgtgtttgtatggtgtttccttggtgcctgcgtggagagagagctctaagtgtctcatcttctgtaaggacaccagccccaatgggattagggccctatcctgtgatctttagttttatgtaccccctaaaggctctatgtccaaatgcagtcacactggggtttagggttttaataaatgaattttggggggacacagtttagtccataa

SEQ ID NO: 334997 - DNA, 273 bp, Homo sapiens
cagcctggacaacatcatgagaccctgtctctttaaaacacacacacacacacacacacacacgcacacacacgcacacacgtatgcatgtaagaaacccaattcaaaaaggggcaaaggacttgaagagatatttctccaaagacatgtaaatggccgatgaacatgtgaaaagatgctccacatcacacacgcaaacgcacagcacacacaaacgcacagcacacacgcacacacagcacacacacgagcacacagcacacaaacgcacag

SEQ ID NO: 334998 - DNA, 847 bp, Homo sapiens
gattagaaggtacttgataattagggggattagaagaacctcctaatctgagtaatttgaataaactgagggaaattgtggaaaagaaagattacaaggtgatgaaaaagagagtagataatgaagagggtgtaaaaacttataaggtactggaaagggcagccatgaaattcctgaccatggaacccaaactgagagatgacagacttgaaggatatggagaaaaagattcaagttcttggcggagaaggtcatgttcagaagcaagtaaggtagtgagagcggtgagaacaggaaacagttaaagaaggagagctccagagtgaaaatcttgtgtttgatggtcccttcagtgatgctgatgcggttgaggtgtgttatttttatgaatagttgagcagaatggaggtgaagtgggtgagaaagtgtgaaactgtgtgtatgtagttttacaacgtgtctgtaaatcctttgatatttttccctcgtgaagtatagtgtaatttccttctccttaggtatggctagccttagtcatatgtttctaacaaataaaatgcaatgcatatgatgctgtgtgggttctgaggctaggccctaagaggtgatatggcttctgtctgtctctctcttgggatgcttgtcattggaacccagctgctatgctttgaggaagcccagggtacatggagagatctatatacagggacacttaagcctgggaccctcagcctaggctgagctcctggacaaatccagcactagcttagcagtcctggaggtgaaccatctggaaagcagaccctcaaatcttgctccagcttctccacatcagaactcgttagga

SEQ ID NO: 334999 - DNA, 405 bp, Homo sapiens
aagatgaaccctattagcacttcacttctctagctagtactttagccattattcttgtcctttcacaaactttttccattggcagtcataagagtatcttaccctcctgtgctctcagcaatcatttttgccctgctaggagaagatctgaattcatctttgtactatgctctgtctgcgctattgcacactcttggtaagatgctggctgcatggcaagttgtaggttcacactgcctagcagatatgttggctgacctcataccatgcagtctataccagagactagctttagcaacttcctttggaattttaagaccattatctctagatgctgaatattgagaatttactagtaaatttagtgcttctaggacgtagtggggagggataaggaaaaaaata

SEQ ID NO: 335000 - DNA, 3191 bp, Homo sapiens
  misc_feature (122)..(123): n is a, c, g, or t
tgagaaaccctatgaatgtaaagagtgtggggaagcttttaggactagccgtcaacttactgtacatcatagatttcattatggtgagaaaccctacgaatgtaaggaatgtggcaaggccnnagtgtgtatggacgacttagtcgacatcagagtattcacactggtgagaagccctttgaatgtaacaaatgtgggaagtcctttaggctcaaagcaggccttaaagtacatcagagtattcatactggagagaagccacatgaatgtaaggaatgtggaaaggcctttcgtcagttttcccaccttgtgggtcataaaagaattcatactggagaaaaaccctatgaatgcaaggaatgcgggaagggctttacatgtaggtatcaacttaccatgcatcagagaatttattcaggggagaaacactatgaatgtaaagaaaatggggaggcttttagtagtggccatcaacttactgcacctcatacatttgaaagtgttgagaaaccttataagtgtgaggaatgtgggaaagcctttagtgtgcatggacgacttactcgacatcagggtattcatagtggtaagaaaccctatgaatgtaacaaatgtgggaagtcctttaggctcaattcatcccttaaaatacatcaaaatattcataccggtgagaaaccctacaaatgtaaggaatgtgggaaggccttcagtcagcgtgcacaccttgcccatcataacagaattcatactggttacaaaccctttgaatgtaaagaatgtgggaagtcctttcgttgtgcctcatatcttgttatacatgagagaattcatacgggagagaaaccctatgtatgtcaagagtgtgggaagggttttagttatagccataaactcactatacatcgcagagttcatactggtgagaaaccttatgaatgtaaggaatgtgggaaggcctttagtgtatctggacaacttactcagcatctgagtattcacagtggtaagaaaccctttgaatgcaacaaatgcgggaagtcttttaggttcatttctgtacttaaagcccatcagaatattcatagcgctgagaaaccctacgaatgtaaggaatgtggcaaggcctttcgtcatgccacaagcctcatatatcatgaccgaactcatgctggtgaaaagtcctatgaatgtaaagaatgtggggaaacttttagtcatgcttcacatcttattattcatgagagaattcataccagtgataaaccctatgaatgtaaaagatgtgggaaggcatttcactgtgcctcatatcttgttagacatgaaagcgttcatgctgatggaaatccctatatgtgtgaagagtgtgggaaagcttttaatagtagccatgaacttagtatacatcatagagttcatactggtgagaaaccctttaaatgtaacaaatgcagaaggtcctttaggcttagatccatccttgaagtacatcagagaattcatatttgatagagaaattgtggcatatacaggtagtaaagaaagcacattgtgtcaatggatttatcccactgaacaatttgaatgaagacaatgtggaatggctttgagatacagttcagtttttattaggcatcaatttgtattggtgtgaacttttcaaaatgtaaatcatatatgcagtttctttggtatgacctgtgttaactcagattcagagaatttataatgtatttttttaataacataagaaaacttttctgatattcctctagttttggattgccaaaatattcatagtagaggaaaactgagaaaacgtaggaaaccattctttatacttgcatgtaaacatcttccagcaacaatcatttattgttaaacctggaaaaagccattacacaggaaacctctgttgatataagcgatgatgggaaaggctatttagccactctgcatatttaatgctcatgatcaacatctgcttcctatagctgggatgatatgggggaagatatttatcccttctggggatcatatataaatgatgatagtagtacctacagtatagtgctgttagaattacatgagttagatgtggaggtcagagtggaagcaggtgtgagagggtcccgcagaagaaaacatggctgccaaagtgtttgagtccatcggcaagtttggcctggccttagctgttgcaggaggcatggtgaactctgccttatgtaatgtggatgctgggcacagagctgccatctttgaccaattccgtggagtacagaacattgtggtaggggaagggactcactttctcatcccatgtgtacaaaaaccaattatctttgactgctgttctcaaccacgtagtgcgccagtcatcactggtagcaaagatttacagaatgtcaacatcacactgtgcatcctcttccggcccatcactagccagcttcctcgcatcttcaccagcattggagaggactacgatgagtgtgtgctgccgttcattaccacggagatcctcaagtcactggtggctcgctttgatgctggagaactaatcacccagagggagctggtctccagccaggtgagcaacaaccttatggagtgagcagccacctttgggctcattctggacgacgtgtctttgacacatctgaccttcttgaaggagttaacagacaggtggccccccaggaagcagagagcgccagatttgtggtggaaaaggcggccatcatctctgctgagggtgactccaaggcagctgagctgatcgccaactcactggccactgcaggggacggccagagcgagctgtgcaagctggaagctgcagaagacattgcataccagctctcatgctctcggaacatcacctgcctgccggcagggcagtccgtgctcctccagctgccctagtgaggccccagcctacctgcacctccgtgaggcaactgggccacagccccgatgattcgtaacaccacctttcgccctcaccccagaaatcactgaaatttcatgattggcttaaagtgaaggaagtaaaggtaaaatcacttcagatctctaaaaaacaaagaattacatgagttagtacatgaaaaaattatgggaaactacatgaaatatactgttacgttcaataaacattagcttctgtatataataatatcaaa

SEQ ID NO: 335001 - DNA, 1728 bp, Homo sapiens
ccctgcagggtcatttctgaacgcattcccaaatatcctggtcctcaagcccttaccaccccctagcacacgaagccccagctggcggtggagcaggtgtgttgctggtagctcatcgctggcttggagatagaggtgcttggtacctgtcccctttccgacaacacctgaaaccgtatcggggcacacccctcatccaaatatccacgtttaaggtgtccggattcgtttggcttgaccaccccctccccgcgccaaccctggaggcatcttccgtggggtctgtctcttcgaacccaaaggggtacgcgtctgggtgagccaggtccgcctcttccctggcgctggccgggggcgggggtgggtaggctgggacctgtgtctgattagctgggagggggaagccatggtcccaaccgctgtctgctgagctccagtccgtccaggctcttccaggaggaagaggcacgatacaagagaggaggggcaggggtcgcagcactgaacaccctggccggggttttgacagctgccacagtctctgagctccagcctcgcgcctgaacccggtccctgccatggggcccccttccagctcaggcttctatgtgagccgcgcagtggccctgctgctggctgggctggtagccgccctcctgctggcgctggccgtactcgccgccttgtacggccactgcgagcgcgtcccaccgtcggagctgcctggactgcagggacttggaagccgagtcttcccctcccctcaggcagaagccgacgccgaccccgaaacccagcagtgcacgcgagctagcggtgacgaccaccccgagcaactggcgacccccggggccctgggaccagctacgcctgccgccctggctcgtgccgctgcactacgatctggagctgtggccgcagctgaggcccgacgagcttccggccgggtctttgcccttcactggccgcgtgaacatcacggtgcgctgcacggtggccacctctcgactgctgctgcatagcctcttccaggactgcgagcgcgccgaggtgcggggacccctttccccgggcactgggaacgccacagtgggccgcgtgcccgtggacgacgtgtggttcgcgctggacacggaatacatggtgctggagctcagtgagcccctgaaacctggtagcagctacgagctgcagcttagcttctcgggcctggtgaaggaagacctcagggagggactcttcctcaacgtctacaccgaccagggcgagcgcaggtaagggctgtacagcccggggcccctctcggcccccgcccctgcgtcccggtgcaggctgcgggtccagctgactaccgtgtccaggtgcgcgtctgctgccctttccaaagaatccccttgcgacgttttcttttttctttttatttatttattttattatactttaagttctagggtacatgtgcacaacgtgcaggtttgttacatatgtatacgtgtgccatattggtgtgctgcacccattaagaaatatacccattaggtatatctcccaatgcaaactatcgcaaggacaaaaaaccaaacagcgcatgttctcacccataggtaggaattgaacaatgagaacacttggacacaggaaggggaacatcacacaccgcgacgttttctttcaaagccagacagagtgcgagcgcctcctttctcccttttcctataaccttgctcc

SEQ ID NO: 335002 - DNA, 586 bp, Homo sapiens
gcctcctggatgatacaccccttgtatccccaaagtcacatcaaacctggacatcccaactgaaacacatcacctccccaagctgctccctctggggtttaccatgttggtgaccgctgcaatactccctcagtctctcccaggccagagacaggttctgtctcttctgcctccagtcactctgtttccacagcaactggggtaacagaatgaaatgtgatttccctggagtcacttgatcataagagagcccagtggaatcatcacccactaagtaataaaaacacaaatccctccctctacacaaacacctacatgttgacagagcacttgtgcagacattatgtcaccgaattttcacaactccgggcttggatgtcattattcccaatggacacatgagaaaacaggttagagaaatgaaacaattttcttgaggtcaccgattaagaggaagagctgggggcttgaatctagatctcaagactaaaactgtcagcaatctgtatctatcacagtttaaaagactgaggtcaggtgcagtggctcatgcctgtaatcccaacattttgggaggccaaggtgg

SEQ ID NO: 335003 - DNA, 237 bp, Homo sapiens
aatgccaactgtactagctaggctaacactgctaatagactccaccaattgtattaactttgctaatactactaagtattattagtatgctaataataactatgctaacaatacaaaccaacaatactaactatactaactgcactagaaatcctaactaaaaaagttaaatgggaaaaaagaaaaaagtgagaaaaattgcaaagaaaatagatgaaatgggaaaaagaaaaaata

SEQ ID NO: 335004 - DNA, 788 bp, Homo sapiens
aattaatatttgcaccagttgtaaatagttaaaaacaaatcaaaactatagattttgcctggtggtaaagtttttgcaatttcctctgaaaaatgataaagattgatttactttgtgcttattacatggctactgcaaaccaaatccccctattaaagtactttgccaaatagacgataattagaagtaaatctagttgtgggatagtggaaaaattccatgaattttgcagctttaattgtgataataaagtatactgtttgttttacaataaacctgcagtatagtatatcataatctcaaaatgccttttcatcaagtgacatagaaatgtctgaattggacaatgagactttttaaaacaagtatttggctcatttaatatctctttttgggcagaatggaacccagttaagtgtaatattcagtgtttatcttaataagtttaaacttgcagtttaagataacttcaggttggctgtgtttaagctagcaaagaggaactatgtcagggttaatgcatgtatagagaagtaccagtcacttttttgactttataaataaattggaaaaaaaagtttctgcgttgtatttgtaggtttgtgtagtaattgagaacaaagtttcaaaaatcagaactaaatttggatataccttttcaccggttttgggtactccatgtacagtatttgttagaaaggactatatgctcatcgtttggggattaatgttttgtgtgattttctttgtgactgtgggtactaactgtaatgtatgtaaactgccat

SEQ ID NO: 335005 - DNA, 1350 bp, Homo sapiens
cggcaaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattgaa

SEQ ID NO: 335006 - DNA, 955 bp, Homo sapiens
cggcaaacagccggggctccagcgggagaacgataatgcaaagtgctatgttcttggctgttcaacacgactgcagacccatggacaagagcgcaggcagtggccacaagagcgaggagaagcgagaaaagatgaaacggaccctgtgagtatggctttcttccctctcccgccaccccctgccccacactgcaagctgcaaacgcggtactttcgggctcgcctttgacgttaggaaactagcctgagcctatgcagggaaaaaaaatcgaaaaggtcaatttgttaagtaaggttaaatctgggtgatgctcgggtacagtttaagaaccgagggagacagttgatatgagggcggtggttgatgcgctaagaaattgcgggttggctttttgtcctcctgcattcaaaatgacatcagaatcctgcggctgaagcgcgtccccagcattcatacgttgcatgatgagttctcatcagcttacacagctactggaaggtgatgctcttgctggttctgaatatactcgtttaaaatccatttttgttttttaattatagagcagatctcacccagtccgaatgtggaacaaataattgttatgcagcgtctgcttaaaagaagtgtcgtaggtggggaaggaagagcgcaggggaatcagtcacccacctctttgtacagtctctggcgtggtccagaacctcctgctctaaagagagaagcgtgggccggctccagacagttccatgtctgtccttttcattaaagtgcaaaacgtctcggaattgtaattaaccttgcaaacaaactgatgccctttgtgagccagaaatagtgtctgccttttgaactaaattcattaacaattctttaaaataccctagtgattataggtagccctgcccttagttgtaaaactagtagatacggtcagattaatggacgaaactgctc

SEQ ID NO: 335007 - DNA, 320 bp, Homo sapiens
cggcacgaggctgttgtctcatgcaatgcaaacacggaccatttcagttttagcattacatgagacaacagtactgatgatctgtggtcataagaacttcaataccgttgcacatagtaaacacttcactgttactgaatcctaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattgaa

SEQ ID NO: 335008 - DNA, 1428 bp, Homo sapiens
cggcaaacagccggggctccagcgggagaacgataatgcaaagtgctatgttcttggctgttcaacacgactgcagacccatggacaagagcgcaggcagtggccacaagagcgaggagaagcgagaaaagatgaaacggaccctaatcctgcggctgaagcgcgtccccagcattcatacgttgcatgatgagttctcatcagcttacacagctactggaagtttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattgaa

SEQ ID NO: 335009 - DNA, 1186 bp, Homo sapiens
cggcaaacagccggggctccagcgggagaacgataatgcaaagtgctatgttcttggctgttcaacacgactgcagacccatggacaagagcgcaggcagtggccacaagagcgaggagaagcgagaaaagatgaaacggaccctatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattgaa

SEQ ID NO: 335010 - DNA, 1604 bp, Homo sapiens
cggcaaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagaggtaaggaaacaagttcctaatttcagcacaatctggacatctttagcacaaaagtgaaacaaagtaatcaaggacaaagcgggctaggaggggtaaaaagtccctccacgttgtagctttcagttatgttaaagttctcctgtgacttagctagtaaagctaatcacacataatttttattttttgttttcaaatactaaattttaatctttaactctgaataccaaataaacaacttttttgttttatttcagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattgaa

SEQ ID NO: 335011 - DNA, 1706 bp, Homo sapiens
cggcaaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagtaagttgagaatcctgtgcttgcaaatatcaatagttagctgctgaactgaaaaggggaactctgatgtgcgtaagctaacatacagaacctctcttgcaggccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagaggtaaggaaacaagttcctaatttcagcacaatctggacatctttagcacaaaagtgaaacaaagtaatcaaggacaaagcgggctaggaggggtaaaaagtccctccacgttgtagctttcagttatgttaaagttctcctgtgacttagctagtaaagctaatcacacataatttttattttttgttttcaaatactaaattttaatctttaactctgaataccaaataaacaacttttttgttttatttcagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattgaa

SEQ ID NO: 335012 - DNA, 1397 bp, Homo sapiens
tattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaatctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattgaa

SEQ ID NO: 335013 - DNA, 920 bp, Homo sapiens
cggcaaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagagataaacatagattttcaaaccaaaactctgattgcccagaatatacaagaagctacaagtggctgctttacaactgcccagaaaagggtatacagcttgatgggagcaagatgcgccatcttgctcccatcaggatttcattaatgtatataaatgacaatgctaggattaatgtcttcctatactatccatgtattccccgcccctcctagataccctgtgtcaaacaggaaacttccacagatacagaagaggcatggtacaatgttctaacacatgaaatcaagttaagatttctgttcctcttgatttgggttctcaaacaatcctgtttctctgtattcccaattaaatcttaaaactgctctgagctgagaaagggattcagcagccagactacctttaagcaacatagccctgtgacaacactgatgggagaagatg

SEQ ID NO: 335014 - DNA, 690 bp, Homo sapiens
ctgtggtcagaagcatttgacgagctgctagccagcaaatgtaagttaactcttgagcttgagccattgctaacatcgcaaaagcctggaaaggctgcgtccacctaacaaaagagcagcttgcctgagggggattagactgcagtcactataggataaagcctgtttttctttcctttatttcccagggtttaacaaataaatgcatatattctctccaggtggggaagaaaatcagcctaaacaaattaaagtggcagttgcttatagttaaggttgagtcagtttttccattgcatacaatgttttcaagaggcttagttcccagagaatttatggctcccctataaatatttactttgcattgacagcaaagtacttatatttttgcagcagagtgccaacataagccttttgcctactggtatcttagtctttaaaaagctaaattttgagaattacaggtttgagcgaaatctagaaaattcatttagaaataattaaaatgtgagggataggagaaacataaggaatcatttggtctctcagttcttcacattctgcatgctctcttttctccccccttcagatggtcttgctgcattcagggcttttttaaagtcggaattctgtgaagaaaatattgaattctggctggcctgtgaagacttcaaaaaaaccaaatcaccc

SEQ ID NO: 335015 - DNA, 1704 bp, Homo sapiens
cggcaaacagccggggctccagcgggagaacgataatgcaaagtgctatgttcttggctgttcaacacgactgcagacccatggacaagagcgcaggcagtggccacaagagcgaggagaagcgagaaaagatgaaacggaccctgtgagtatggctttcttccctctcccgccaccccctgccccacactgcaagctgcaaacgcggtactttcgggctcgcctttgacgttaggaaactagcctgagcctatgcagggaaaaaaaatcgaaaaggtcaatttgttaagtaaggttaaatctgggtgatgctcgggtacagtttaagaaccgagggagacagttgatatgagggcggtggttgatgcgctaagaaattgcgggttggctttttgtcctcctgcattcaaaatgacatcagaatcctgcggctgaagcgcgtccccagcattcatacgttgcatgatgagttctcatcagcttacacagctactggaagtttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattgaa

SEQ ID NO: 335016 - DNA, 1896 bp, Homo sapiens
  misc_feature (1366)..(1366): n is a, c, g, or t
  misc_feature (1896)..(1896): n is a, c, g, or t
cggcaaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattgaaaaaaaaaaaaaaaaanaaaaaaaaaaaaaaagggggggggggcaaaaagataccccctccgagaggggccgcaagtcttaagcgcgcggttacgcccgaggtttttctctgggtcaaaaaggggggggcccctagataaagggaggagaacgcgcaaattaataaaagccagaggacagcggggcccggccgtgtaacacacaaccagttgcgggacgtgggagaaagacgcggtctcagcctggggagatccgttggggaaaggggagaccccctatattcttgcgtgggggggggcgaccctatactgtgggcgaccaaaactatacccttaaggagaagatattttaaagcgcgaccccaagggggaacaattaatttaaacaccttttttcaagggtgtttttacgtgggggtgtttaacaccatgaccggggtatttgtgccctcgccggtcttagaaaaaaatttggtcctcaccagcgaaatatgaatatttggcaataattttttatccgccggacgctgtggctaataataaaagan

SEQ ID NO: 335017 - DNA, 1655 bp, Homo sapiens
  misc_feature (1399)..(1399): n is a, c, g, or t
cggcaaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattgaaaaaaaaaaaaacacctcttattacaaaaaacctaaaaaaaaaaaaaaanaaaacccaaactataataacatcttaaaaaaaaaaaacatggtggcccggttgggccaagcggatttatgacttgggcaaggttatggcatgcggcccgaattcggggtctaattggccaaattgcccttaaaggggggcgatttaaattccaatggcccgcgttttacaaaggtcgaacttggccctgtgggttccccaacttaatcgctttggaagaacaacccctttttcgcggtggggtatatcggggcccc

SEQ ID NO: 335018 - DNA, 1278 bp, Homo sapiens
cggcaaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgcatgagacgacaggagagatgaactgggagcatgtgggctgaggtagctggtggtacatctgaccctaaatcgtttca

SEQ ID NO: 335019 - DNA, 993 bp, Homo sapiens
cggcaaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagccgcagggtttttccagttcaagaaccaaggtaaaagacgtgctgcgaaagcattgaaaat

SEQ ID NO: 335020 - DNA, 1183 bp, Homo sapiens
atagtattgggcatccttcttatttgtgttatttgatgctgagtgtgagcactttctctgtgtcagggtaagccaatgatctgagtagggcttgataatgccattggagagtctgacaagatcaaagtgtaaatgggagagaagaggaaaagaaggaaagaaatgagagccacatatctactggcaaaaggaaaagtgcaaaatttccaagggcaggctgctgaaggcctgccagagcgggatggaaggcaaaggttgttgaagttatgaatgtctgtttcacagaactaaatatgaacagctttattaaggagatggctcatcccaggataaagacagcaacagatgatatagagaagattacaccaaacaaatctgctgtaaactgcatttacccttaggagatgataaactaaagatgaagggaagggataatgaatgaatgttaagagctaaaaactataaaactcttagaagaaaatatagcagtaaatcaacaaaaccttggattaggcaacagtttctcagatatctcatcaaaagcacaagcgacaaaattaaaaaatagataaattggacttcatcaaagtaaaacttttgcgttccaaagaataccatcaagaaagtaaaaagacaacccacagaatggaagaaaatatttgcaaatcatatatcttaagagaattgtagccagaatataaaaactctcacaactcaacaataaaaaaacaaataactcaattttgaaagtggacaaagggatagacctacaaatgttcaataaacacatgaaaagatactcagtatcattagccatcagggaaatgccagtcaaaaccacaatagataccattttatgcccactagaatggctataagatagataatactaaattttgtcaaagatttggagaaatcaaacccttacacattgttgatgagaatgtaaaatggtacacaatttttggaaaacaatctggcagttcttcagagttaaaacaaaaagttaccttgtgacctagcaatcccattcgaagagagttaaaaacatattttccaacaaaagcttgtacatgaatgtttatagcaacattattcattatggccaaaaagtggaaacagcccaaataaatgttcctcagctgatgagtgggtaaataaacgtggtatgaacttaaaaaaa

SEQ ID NO: 335021 - DNA, 1509 bp, Homo sapiens
aaagtgaattgtttcttgttttggaagggattcagataaataaaaagttaaagatttgccaacaaatacgagaacaaatacaccatttggaggggatcaactaccatacatatccaatgcccaaggaaacaaaaactaattttgcccccaacttacaaagatcaatgaatacagaattcagagagaaagtgtgatattattttctcaaaggcataatgaaaaatttccaaacccaaacatcttggcagacaatggctcaactgaataatcaaaaccccaggaacaatgggccacagatgcagaaagggccctgggtggtcaggtttgtggtggggtgacagcttgccaagcagcaagggcccctctgaagagttctgcagttgtattctttcttcctcaggatttaggtcacaggagatggtcctgctttaaaccaccaaccttcaaaccacctccaaagctgtcaatgcctggaggaactccagtctttgtctgtggtagggcagacaaagctgactggaagttggaaagcatattttattacatatgtgtttgttttttgacaggatggaaggcaaaggttgttgaagttatgaatgtctgtttcacagaactaaatatgaacagctttattaaggagatggctcatcccaggataaagacagcaacagatgatatagagaagattacaccaaacaaatctgctgtaaactgcatttacccttaggagatgataaactaaagatgaagggaagggataatgaatgaatgttaagagctaaaaactataaaactcttagaagaaaatatagcagtaaatcaacaaaaccttggattaggcaacagtttctcagatatctcatcaaaagcacaagcgacaaaattaaaaaatagataaattggacttcatcaaagtaaaacttttgcgttccaaagaataccatcaagaaagtaaaaagacaacccacagaatggaagaaaatatttgcaaatcatatatcttaagagaattgtagccagaatataaaaactctcacaactcaacaataaaaaaacaaataactcaattttgaaagtggacaaagggatagacctacaaatgttcaataaacacatgaaaagatactcagtatcattagccatcagggaaatgccagtcaaaaccacaatagataccattttatgcccactagaatggctataagatagataatactaaattttgtcaaagatttggagaaatcaaacccttacacattgttgatgagaatgtaaaatggtacacaatttttggaaaacaatctggcagttcttcagagttaaaacaaaaagttaccttgtgacctagcaatcccattcgaagagagttaaaaacatattttccaacaaaagcttgtacatgaatgtttatagcaacattattcattatggccaaaaagtggaaacagcccaaataaatgttcctcagctgatgagtgggtaaataaacgtggtatgaacttaaaaaaa

SEQ ID NO: 335022 - DNA, 1001 bp, Homo sapiens
  misc_feature (56)..(56): n is a, c, g, or t
  misc_feature (58)..(58): n is a, c, g, or t
aatctacattctagtggctgcggtacattcaaatagaaattcacaaccacccttgngngatggaaggcaaaggttgttgaagttatgaatgtctgtttcacagaactaaatatgaacagctttattaaggagatggctcatcccaggataaagacagcaacagatgatatagagaagattacaccaaacaaatctgctgtaaactgcatttacccttaggagatgataaactaaagatgaagggaagggataatgaatgaatgttaagagctaaaaactataaaactcttagaagaaaatatagcagtaaatcaacaaaaccttggattaggcaacagtttctcagatatctcatcaaaagcacaagcgacaaaattaaaaaatagataaattggacttcatcaaagtaaaacttttgcgttccaaagaataccatcaagaaagtaaaaagacaacccacagaatggaagaaaatatttgcaaatcatatatcttaagagaattgtagccagaatataaaaactctcacaactcaacaataaaaaaacaaataactcaattttgaaagtggacaaagggatagacctacaaatgttcaataaacacatgaaaagatactcagtatcattagccatcagggaaatgccagtcaaaaccacaatagataccattttatgcccactagaatggctataagatagataatactaaattttgtcaaagatttggagaaatcaaacccttacacattgttgatgagaatgtaaaatggtacacaatttttggaaaacaatctggcagttcttcagagttaaaacaaaaagttaccttgtgacctagcaatcccattcgaagagagttaaaaacatattttccaacaaaagcttgtacatgaatgtttatagcaacattattcattatggccaaaaagtggaaacagcccaaataaatgttcctcagctgatgagtgggtaaataaacgtggtatgaacttaaaaaaa

SEQ ID NO: 335023 - DNA, 924 bp, Homo sapiens
tcgtctggtagccggatcgctgagtgtactgggtggtactgagtcctagacgtatcgggatatgttcgggtacagaaagtgcggtgttgaagtcctcgctgccactctgtttttagatctgccaagactgacctttgaactttcctgtagtcaatcttcctcgatctaccagatgggagagacccttggacaactttataaactcctgtttgccttttttggatcagcgacagcccccatcgctgtgactattggggaaaagacgaagctctttcataaattccatggagaggaatcaatatcccactggaaggctagaaatggacaagatagtgtatttgcaatcacaaacaaaaccctagtgatgaaaaataatttgtgatggcagatgcttctgatggtgtgatagaatatgtttttgaaaacaaaccatcgaaccccccgccccacccccaaaacgggcttccctgtgtttagggagctttgggctagaactagctacgatttttaggtgaaatgtccttgtaattgtacaaagcacttggtgcagtgtttgcgtggagcagcctgctgctttctgatgcattccctgtttaagtgcgtttaacatctacctcacaagccctgaaaccccaggcaaaacccacagaaagctcatacccggtgcaggagtttgccatcccaagtggctttttttccatatgtagccaaaaaggattgcagatagcgtcggtgcgtcccattcgaaccttgtcacgtttgagctatctttaccctgtgatttacttttagtaagggtgatcatggtgaaaatatttgcagacagctgttacagtacactatatggtcaccaagtaaccttatatttttctttatatattttacaaatgtaacccctgtcattgaagcaaccgtggaagaggc

SEQ ID NO: 335024 - DNA, 149 bp, Homo sapiens
tctcacctcagctgaaaccatggcagcaagaaagacatgggtggtttatctgggatttgtattttctacattaatgcttcctccagtaacgaggttaattgagagttgacagtaattgctgtatgtgagcatgaagccctaaatatgat

SEQ ID NO: 335025 - DNA, 336 bp, Homo sapiens
cacaagctctgagatccaacagcaggccgtgaatctcagctccaccttggaggagctgtgtgaccttgggcatgttcctgaacctctctgggcctcagtttcctaacccacagaatggactggtaacaataccagttctcaggggcttcacgtagatgtgggcacacagcaagtaccatcacccagggccaccccagtcagctccagacaccagggtgagcagcctgagaaatcgtgacataaacaggcactggggacacacttcagtaccagggtctcagcctcacttcctgcctgcccccaaagggcagctctgctcttgtacccatgcccagg

SEQ ID NO: 335026 - DNA, 461 bp, Homo sapiens
cacatagttttcactttttcattcatttgttaatacgacaggtatttcctgagcacctaatatacaccaggcactgttctaggtactggagatgaagaaacccctgctcttacggttcttcataattaacatttggagactctatacaagcacatgtgttgttggggacttaaattcagtttgttgtatgaataagaaaagccatgattgatatgagagccaccagctttccgtgtcttcatatcagcttctgacctgtaattgtctccggtcccagggagaagatagcattcttcacaaggccaaggatcaacatacctcctctcccagccgacgacgtctgatggagtgcattgtgcacatgaagtatttatccacctgttttattttcatgaagttcttagactagctgaatttgtctttaaaatatttgtgcaaagctattaatatacacattttgt

SEQ ID NO: 335027 - DNA, 3314 bp, Homo sapiens
cacatagttttcactttttcattcatttgttaatacgacaggtatttcctgagcacctaatatacaccaggcactgttctaggtactggagatgaagaaacccctgctcttacggttcttcataattaacatttggagactctatacaagcacatgtgttgttggggacttaaattcagtttgttgtatgaataagaaaagccatgattgatatgagagccaccagctttccgtgtcttcatatcagcttctgacctgtaattgtctccggtcccagggagaagatagcattcttcacaaggccaaggatcaacatacctcctctcccagccgacgacgtctgatggagtgcattgtgcacatgaagtatttatccacctgttttattttcatgaagttcttagactagctgaatttgtctttaaaatatttgtgcaaagctattaatatacacattttgtaaaaaaaaaaaaaaaacacgtatatctatacatatatattttataatagtgacggcaacagggcttggtttttccttgttgtgaaatcgacatctctgaagacaggttattttataaaagatcaactatcatgttaagaatgtacagtttttatgctgttttatttgacttaaaggctggaagacagaaacgaagtgagttcaggcaaattcactgtattgtaatttatttatagtacttttttttccttgaaggaaaatactgactttaagatgtattttaagactgaaattttgttctttagtacttttcatgcagtagaacggaacttggggctggtttggtttttgacacctgaaatgcgaacgctatgtgctaaatttgtcaccgtatcatatgtgcatttaccatgtatattgtacacattcactcccttgatgtcatgttaaaatgtcccctgcagtggttcaatcgtgactcggaagcatgtgtgtgttgcagaggtcagtctctggcgtgggccgcacgccaaccgctcatttctgtgttgcctttggaagcatctttctgtgctcagcgtgagtctgaagcaggcgccagggcctctggtgtacggggcttcagcctgcttgcttgtggtggctgtctgtggggcttcagcctgactgtccgtggtggctgtccatgctgcccgcctccccccaccccgccctgtccgactgtaacagaccaggagggtggcggaggaactcctgccacgccactgtgtcatgaaggaaagtgaaagggaacgaggaagtaggaatgcccacgctcgttgactccgtgggtgaatacagcagttaggacatacacaccatcacctttgaaagtgcttgtttgggggagggaaggacatacgggtaactagaactacccagcgagtcgtccagaggagaggatcaggtttgagtcaggaggctccctgtactggagtcgtcccactattcctcaagaaatcttagaaccagcttgtgaggaaaaacattttttaatgtaataaaaatatgccattattctttgaaatgccaaatgatataaatattttgcctaatacatatttattgtagatgaaatgcactcttctcgatgaggcctcgatttgaatcaatggggtgggccacaggaaatgtcagaggaaccagaactcagaactcttcctcctggacctttcttcccttcccttggaggtatccctttgaatcaggcctctctcttctcatcagtctgtagcttccccccttgtataacctgctttcctttttacatttattaaaagtggattttgtaaaagcatttcattgacacgcgacctatcacagacaatggaattcgtcagtggtggtaagactgaaatcctgatgcttttcacacttcttgtctcttgctatgtatttctgcctctagccttgccatgttttgccttttttttttctttttggccaattcctttttatatgtgcccacaacagaggtggggagacacggagcaccctgggtccttcccagcgctgctgggcaggccccgtctccaggccccagctgttgaaactttgaagggcaacaaacaaccatccacactgccggaccctaggctgttcagggaggcagctcatttccaccccggccccaggacacccagcctgtgccccacaaggatctctctaaatgggagggattgaggctacttttctgccaagccctattaagtagtaatgtggggaaacccactgtgtcagtgcaggaagccctagacaaatgttttcaaataaatttcactgcccagcctgcacagatttccatttgaagtacttcccatccaccctgacacccaaaggggtttttttgttttgttttgtttttgagacagggtcttgctttgttgcccaggctggagtgcagtgacgtggtcatagctcactgcagcctcaacctcctgggctcaagtgaccctcctgcctcagcctcccaaagttctgagatgataggcatgagccattgtgcctagcctattttgatttttttcttagagtcaaggtcttgctctgttgcccaggctgatcttggacttgcgagccaccatgcctggctgggttttttaaaaatagaatctcactgatagcctgcaagaaacagatgcagtgcctgcttccgtatcagtccaaggagccctcgtgtttgccacctttacctttgaacctccccctgcctccctgcctgtgtccgcttttgcagctcaatgcagccatgacaaggaaagaaaagacaaaggaaggccagagagccgcgcagttctctgcaggtgcagatgcaggcagtggaggtggcctgagcaggcagaaggacaccaagcgccctatgttgcttgtcattcatgacgtggtcttggagcttctgactagttcagactgccacgccaaccccagaaaataccccacatgccagaaaagtgaagtcctaggtgtttccatctatgtttcaatctgtccatctaccaggcctcgcgataaaaacaaaacaaaaaaacgctgccaggttttagaagcagttctggtctcaaaaccatcaggatcctgccaccagggttcttttgaaatagtaccacatgtaaaagggaatttggctttcacttcatctaatcactgaattgtcaggctttgattgataattgtagaaataagtagccttctgttgtgggaataagttataatcagtattcatctctttgttttttgtcactcttttctctctaattgtgtcatttgtactgtttgaaaaatatttcttctataaaattaaactaacctgccttaa

SEQ ID NO: 335028 - DNA, 1008 bp, Homo sapiens
actaagttctagatcgcgagcggccgcccttgggtttttttgttttgttttgtttttgagacagggtcttgctttgttgcccaggctggagtgcagtgacgtggtcatagctcactgcagcctcaacctcctgggctcaagtgaccctcctgcctcagcctcccaaagttctgagatgataggcatgagccattgtgcctagcctattttgatttttttcttagagtcaaggtcttgctctgttgcccaggctgatcttggacttgcgagccaccatgcctggctgggttttttaaaaatagaatctcactgatagcctgcaagaaacagatgcagtgcctgcttccgtatcagtccaaggagccctcgtgtttgccacctttacctttgaacctccccctgcctccctgcctgtgtccgcttttgcagctcaatgcagccatgacaaggaaagaaaagacaaaggaaggccagagagccgcgcagttctctgcaggtgcagatgcaggcagtggaggtggcctgagcaggcagaaggacaccaagcgccctatgttgcttgtcattcatgacgtggtcttggagcttctgactagttcagactgccacgccaaccccagaaaataccccacatgccagaaaagtgaagtcctaggtgtttccatctatgtttcaatctgtccatctaccaggcctcgcgataaaaacaaaacaaaaaaacgctgccaggttttagaagcagttctggtctcaaaaccatcaggatcctgccaccagggttcttttgaaatagtaccacatgtaaaagggaatttggctttcacttcatctaatcactgaattgtcaggctttgattgataattgtagaaataagtagccttctgttgtgggaataagttataatcagtattcatctctttgttttttgtcactcttttctctctaattgtgtcatttgtactgtttgaaaaatatttcttctataaaattaaactaacctgccttaa

SEQ ID NO: 335029 - DNA, 7125 bp, Homo sapiens
gcggccgcccccgcgccccgggcgccgggccttagtgctggcgcgggcccgggagagcgccgagctgccgctgcccgccggctgggaggaggcgcgagactacgacggtcgcgtcttttacattgaccacaacacgcgccagacgtcgtggatcgacccccgcgaccggataacaaagccattgacctttgccgattgtgttggggacgaacttcctttaggatgggaaaccgtatatgataaacaaattggagtttattacatggaccacataaataaacttacccagattgaggatccaagagaacagtggaggcgagagcaagagcgcatgttgaaggaatatttaattgtagctcaggaggctctcaatgccaagaaagaaatctaccagattaagcagcagcggttcgagctggcccaggaggaataccagcagctgcacaaaatgtgtgaggatgacagccgctcgtacgccagctcattctctggatattcaacaaatacaaagtatgacccacaccaaattaaagcagaaatagcaagtcgtcgggataggctttccagattaaaacgagagctgacccagatgaagcaggaactgcagtacaaagaaaagggggtggagaccctgcaagagattgatcggaagatgtcaagtactcacaccagctacaaactggatgaggcgcaggctatcatgagtgagctccggaccatcaagaaggccatttgcacaggcgagaaggagaggcgggacctgatgcatagcctggccaagctgaccgatagcttcaagaacagctgctccgttaccgactctctagtggacttccctcaccatgtaggcgtgcctggcgatgctggtgtaccccagcagttctgcgatgccggctcccagactgatatcatcggggagtttgtctttgatgataaaacaagacttgtagaccgagtcagacttaattggcaatatgaagaagccagaaagagagtcgccaacatccagcagcagctggcccggcttgacaatgagtcctggccaagcacggccgaggctgacagggaccggctgcagctcatcaaggagaaggaggccctgctgcaggagcttcagctcatcattgcacagcgccgctctgcgggagatgtggcccggctggaggaggagcgggagcgcctagaggaggagctgcggcgtgcacgggccacctccgcacagggcgccacggagaggattctgcttcaggaaaaaaggaattgtctacttatgcagctggaagaagccacccgcttaacatcctacctccagtcccagttaaaaagcctgtgtgccagcaccctgacggtgtcctcggggagcagccgcgggtccctagcctccagccgtgggtctctggcctccagccggggctccctgagctcggtcagcttcacggacatctacggcctcccgcagtacgagaagcccgacgctgagggcagccagcttctacgcttcgacctcattcccttcgactctctggggcgagatgctcccttttcagagcccccaggcccctcgggcttccacaagcagaggcggtccctggacacgccccagtccctggcatcgctgtcctcccgctcctcgctgtcctcgctgtcgcccccaagctcgcccctggacacgcccttcctccctgcctcacgggactcgccgctggcgcagctggcggacagctgtgaggggccaggcctgggcgccctagacagactgcgggcacacgcctcggctatgggggacgaagacttaccaggcatggcggcccttcagccacacggggtccccggggacggggaagggccgcacgagcgaggacccccaccagccagcgctcccgtgggtggaacagtgactcttcgagaagacagtgccaagaggttggagaggagggcacgccgcatctccgcatgtctgtcggattattcgctagccagcgacagtggggtgtttgaacctctaaccaaaaggaacgaagatgccgaggagcctgcctacggagacacggccagtaacggagatccccagatccacgtgggactcctgcgcgacagtggcagcgagtgtctcctcgtgcacgtgctgcagctgaagaacccggcggggctggcggtgaaggaagactgcaaagtccacatccgagtctatttgcccccactggactcgggcacgcccaacacttactgctccaaggctctggagttccaagtgccgctggtgtttaacgaagtgttcagaatccccgtgcattccagcgcgttgacactgaagtcacttcagttatacgtgtgttcagtgactccgcagctgcaggaagaactgctgggcattgctcagattaacctggctgactatgacagtttgagtgagatgcagctgcgctggcattccgtgcaggtgttcaccagctctgaaccatcaaggacgcgggaggctgggtgtgcaggagagagctccgcccgggaccctgcacacaccatctccatctccggcaagacggatgcggtgacggtgctcctggccagaaccacggcacagctgcaggcggtggagagggaactggccgaggagcgggccaagctggagtacacggaggaggaggtcctggagatggagcgcaaggaggagcaggccgaggccatatccgagcggagttggcaagcggactcggtggatagcggctgtagcaactgcacccagaccagccctccgtacccagagccctgttgcatgggtatcgactccatcctgggccacccatttgctgctcaggcagggccttacagccccgagaaatttcagccctcgcctcttaaggttgataaggaaaccaacacggaagatctctttctggaagaagcagccagcctcgtgaaggagcggcccagccgccgggcccgagggtcgccttttgttcggagtggcacgattgtccgttcccagacattctcgcctggagcacgaagccagtatgtttgcagactttatcgtagtgacagcgacagttcaacgctgccccggaagtccccctttgtccgaaatactttggaaagacgaacccttcgctataagcagtcatgcaggtcttccctggctgagctcatggcccgcacctccctggacttggagctggatctccaggcgtcgagaacacggcagaggcagctgaatgaggagctctgcgccctccgtgagctgcggcagcggttggaggacgcccagctccgtggccagactgacctcccaccctgggtgcttcgggacgagcggctccgtggcctgctgcgggaggccgagcggcagacaagacagaccaaacttgactaccgtcatgagcaggcggctgagaagatgctgaagaaggcctccaaggagatctaccagctgcgtgggcagagccacaaagagcccatccaagtgcagacctttagggagaagatagcattcttcacaaggccaaggatcaacatacctcctctcccagccgacgacgtctgatggagtgcattgtgcacatgaagtatttatccacctgttttattttcatgaagttcttagactagctgaatttgtctttaaaatatttgtgcaaagctattaatatacacattttgtaaaaaaaaaaaaaaaacacgtatatctatacatatatattttataatagtgacggcaacagggcttggtttttccttgttgtgaaatcgacatctctgaagacaggttattttataaaagatcaactatcatgttaagaatgtacagtttttatgctgttttatttgacttaaaggctggaagacagaaacgaagtgagttcaggcaaattcactgtattgtaatttatttatagtacttttttttccttgaaggaaaatactgactttaagatgtattttaagactgaaattttgttctttagtacttttcatgcagtagaacggaacttggggctggtttggtttttgacacctgaaatgcgaacgctatgtgctaaatttgtcaccgtatcatatgtgcatttaccatgtatattgtacacattcactcccttgatgtcatgttaaaatgtcccctgcagtggttcaatcgtgactcggaagcatgtgtgtgttgcagaggtcagtctctggcgtgggccgcacgccaaccgctcatttctgtgttgcctttggaagcatctttctgtgctcagcgtgagtctgaagcaggcgccagggcctctggtgtacggggcttcagcctgcttgcttgtggtggctgtctgtggggcttcagcctgactgtccgtggtggctgtccatgctgcccgcctccccccaccccgccctgtccgactgtaacagaccaggagggtggcggaggaactcctgccacgccactgtgtcatgaaggaaagtgaaagggaacgaggaagtaggaatgcccacgctcgttgactccgtgggtgaatacagcagttaggacatacacaccatcacctttgaaagtgcttgtttgggggagggaaggacatacgggtaactagaactacccagcgagtcgtccagaggagaggatcaggtttgagtcaggaggctccctgtactggagtcgtcccactattcctcaagaaatcttagaaccagcttgtgaggaaaaacattttttaatgtaataaaaatatgccattattctttgaaatgccaaatgatataaatattttgcctaatacatatttattgtagatgaaatgcactcttctcgatgaggcctcgatttgaatcaatggggtgggccacaggaaatgtcagaggaaccagaactcagaactcttcctcctggacctttcttcccttcccttggaggtatccctttgaatcaggcctctctcttctcatcagtctgtagcttccccccttgtataacctgctttcctttttacatttattaaaagtggattttgtaaaagcatttcattgacacgcgacctatcacagacaatggaattcgtcagtggtggtaagactgaaatcctgatgcttttcacacttcttgtctcttgctatgtatttctgcctctagccttgccatgttttgccttttttttttctttttggccaattcctttttatatgtgcccacaacagaggtggggagacacggagcaccctgggtccttcccagcgctgctgggcaggccccgtctccaggccccagctgttgaaactttgaagggcaacaaacaaccatccacactgccggaccctaggctgttcagggaggcagctcatttccaccccggccccaggacacccagcctgtgccccacaaggatctctctaaatgggagggattgaggctacttttctgccaagccctattaagtagtaatgtggggaaacccactgtgtcagtgcaggaagccctagacaaatgttttcaaataaatttcactgcccagcctgcacagatttccatttgaagtacttcccatccaccctgacacccaaaggggtttttttgttttgttttgtttttgagacagggtcttgctttgttgcccaggctggagtgcagtgacgtggtcatagctcactgcagcctcaacctcctgggctcaagtgaccctcctgcctcagcctcccaaagttctgagatgataggcatgagccattgtgcctagcctattttgatttttttcttagagtcaaggtcttgctctgttgcccaggctgatcttggacttgcgagccaccatgcctggctgggttttttaaaaatagaatctcactgatagcctgcaagaaacagatgcagtgcctgcttccgtatcagtccaaggagccctcgtgtttgccacctttacctttgaacctccccctgcctccctgcctgtgtccgcttttgcagctcaatgcagccatgacaaggaaagaaaagacaaaggaaggccagagagccgcgcagttctctgcaggtgcagatgcaggcagtggaggtggcctgagcaggcagaaggacaccaagcgccctatgttgcttgtcattcatgacgtggtcttggagcttctgactagttcagactgccacgccaaccccagaaaataccccacatgccagaaaagtgaagtcctaggtgtttccatctatgtttcaatctgtccatctaccaggcctcgcgataaaaacaaaacaaaaaaacgctgccaggttttagaagcagttctggtctcaaaaccatcaggatcctgccaccagggttcttttgaaatagtaccacatgtaaaagggaatttggctttcacttcatctaatcactgaattgtcaggctttgattgataattgtagaaataagtagccttctgttgtgggaataagttataatcagtattcatctctttgttttttgtcactcttttctctctaattgtgtcatttgtactgtttgaaaaatatttcttctataaaattaaactaacctgccttaaaaaacaaagaaaagaaaaagaacaaaaaacacaaaatacaaaacaaaaagaaacaaaagagaacaaaaaaaaaacacaagaaacacagacacagcaaaagacaagaaagacaaacaaaaaagaagaaaagaaacaaaggacaaggggcaacgacagacaaaaaaacagaagaaacaacataccaaaagaaacacccccagaggaacggacagagaggcagaaccaagtagacccgacagatgccagggagaaggagacacatcaccacgcacacaaagagcacagtcaaagcaacaagacagagaagaccaaggcctcactcacaaaccaaacgaacagcggcccgccgggagcagagaggcaggaaggcgaagaacacaaaaaagaaacaacagagagaccagccgccaccacacgccccaccgcgcaggaaacaatagcaacgaaccgccagccccagtggacgaacggcaaaaaaaacctcccaacattgcgccaacgccgaccgcgaggaggataacaacacgaagatgacacaaagcaaccaaagaacaagtacacccacaccaccaacacaacactgcagccaccgacccgacgcgcgccgaagaaaa

SEQ ID NO: 335030 - DNA, 465 bp, Homo sapiens
gcggccgcctactactactaaattaaaagccgctcgacggagcttctgactagttcagactgccacgccaaccccagaaaataccccacatgccagaaaagtgaagtcctaggtgtttccatctatgtttcaatctgtccatctaccaggcctcgcgataaaaacaaaacaaaaaaacgctgccaggttttagaagcagttctggtctcaaaaccatcaggatcctgccaccagggttcttttgaaatagtaccacatgtaaaagggaatttggctttcacttcatctaatcactgaattgtcaggctttgattgataattgtagaaataagtagccttctgttgtgggaataagttataatcagtattcatctctttgttttttgtcactcttttctctctaattgtgtcatttgtactgtttgaaaaatatttcttctataaaattaaactaacctgccttaa

SEQ ID NO: 335031 - DNA, 437 bp, Homo sapiens
tgctgcgggaggccgagcggcaggtgggggtcccctgtggccagctcccgcctgcacctcactgctccctgctccaggctctgaagggagcctcccagacacggaggtggtccctgaaataccccaccactgggctcttggagtcccttctccctctgtgggctgcgagggtggcgtctgtgtggcttctgcgtgcatctggaggctgcgggtgctggaggaggggtcacgggccctccccaccttgttgggggaacattctgggtccccagtcgctaggcctgactgcagccaccccctggcctctgtctcctgggaggaattccttggggggagtgtgggtgaggtgggccttactccctcctgtcaccactcactgactgtggttggttcttctgggctccagggttggcagtgaacttactcattcttcctta

SEQ ID NO: 335032 - DNA, 569 bp, Homo sapiens
cggttccctcacgtcacccgctgtccggcgcctgggaactgggctcctggaatttcctctcctggggctgacagatggccctcttttcctttctctgcggcagcctcgcccatcccggtcccgggcgtctgcggcccactgccccggccctggttctgcaggtgtccccagccccgcggtggcgagatgagctgtcaccttggatcacaaacgtgcgccccagctttggggtgcgggttccctgtctggcgggttcaggctggtttccatccaaaacctgatgtcagacgggcccttgagggattcccaacccttttggagttggagaagtctgttcccaaactctagttgctctttagcgccttaaaactcgtgagttaaaactgtttgaaatagccttctgtactgcagccagaatgcaatatgattagtcccatatgcttttggaataaacgaaaaacaagaattgtattttaagtttcctttttgtgaaagatatgcatggggtacaaagctgtcttattcacgtataaaaacccaatcaagtaaaaactgattcttgtaaaagc

SEQ ID NO: 335033 - DNA, 6511 bp, Homo sapiens
gcggccgcccccgcgccccgggcgccgggccttagtgctggcgcgggcccgggagagcgccgagctgccgctgcccgccggctgggaggaggcgcgagactacgacggtcgcgtcttttacattgaccacaacacgcgccagacgtcgtggatcgacccccgcgaccggataacaaagccattgacctttgccgattgtgttggggacgaacttcctttaggatgggaaaccgtatatgataaacaaattggagtttattacatggaccacataaataaacttacccagattgaggatccaagagaacagtggaggcgagagcaagagcgcatgttgaaggaatatttaattgtagctcaggaggctctcaatgccaagaaagaaatctaccagattaagcagcagcggttcgagctggcccaggaggaataccagcagctgcacaaaatgtgtgaggatgacagccgctcgtacgccagctcattctctggatattcaacaaatacaaagtatgacccacaccaaattaaagcagaaatagcaagtcgtcgggataggctttccagattaaaacgagagctgacccagatgaagcaggaactgcagtacaaagaaaagggggtggagaccctgcaagagattgatcggaagatgtcaagtactcacaccagctacaaactggatgaggcgcaggctatcatgagtgagctccggaccatcaagaaggccatttgcacaggcgagaaggagaggcgggacctgatgcatagcctggccaagctgaccgatagcttcaagaacagctgctccgttaccgactctctagtggacttccctcaccatgtaggcgtgcctggcgatgctggtgtaccccagcagttctgcgatgccggctcccagactgatatcatcggggagtttgtctttgatgataaaacaagacttgtagaccgagtcagacttaattggcaatatgaagaagccagaaagagagtcgccaacatccagcagcagctggcccggcttgacaatgagtcctggccaagcacggccgaggctgacagggaccggctgcagctcatcaaggagaaggaggccctgctgcaggagcttcagctcatcattgcacagcgccgctctgcgggagatgtggcccggctggaggaggagcgggagcgcctagaggaggagctgcggcgtgcacgggccacctccgcacagggcgccacggagaggattctgcttcaggaaaaaaggaattgtctacttatgcagctggaagaagccacccgcttaacatcctacctccagtcccagttaaaaagcctgtgtgccagcaccctgacggtgtcctcggggagcagccgcgggtccctagcctccagccgtgggtctctggcctccagccggggctccctgagctcggtcagcttcacggacatctacggcctcccgcagtacgagaagcccgacgctgagggcagccagcttctacgcttcgacctcattcccttcgactctctggggcgagatgctcccttttcagagcccccaggcccctcgggcttccacaagcagaggcggtccctggacacgccccagtccctggcatcgctgtcctcccgctcctcgctgtcctcgctgtcgcccccaagctcgcccctggacacgcccttcctccctgcctcacgggactcgccgctggcgcagctggcggacagctgtgaggggccaggcctgggcgccctagacagactgcgggcacacgcctcggctatgggggacgaagacttaccaggcatggcggcccttcagccacacggggtccccggggacggggaagggccgcacgagcgaggacccccaccagccagcgctcccgtgggtggaacagtgactcttcgagaagacagtgccaagaggttggagaggagggcacgccgcatctccgcatgtctgtcggattattcgctagccagcgacagtggggtgtttgaacctctaaccaaaaggaacgaagatgccgaggagcctgcctacggagacacggccagtaacggagatccccagatccacgtgggactcctgcgcgacagtggcagcgagtgtctcctcgtgcacgtgctgcagctgaagaacccggcggggctggcggtgaaggaagactgcaaagtccacatccgagtctatttgcccccactggactcgggcacgcccaacacttactgctccaaggctctggagttccaagtgccgctggtgtttaacgaagtgttcagaatccccgtgcattccagcgcgttgacactgaagtcacttcagttatacgtgtgttcagtgactccgcagctgcaggaagaactgctgggcattgctcagattaacctggctgactatgacagtttgagtgagatgcagctgcgctggcattccgtgcaggtgttcaccagctctgaaccatcaaggacgcgggaggctgggtgtgcaggagagagctccgcccgggaccctgcacacaccatctccatctccggcaagacggatgcggtgacggtgctcctggccagaaccacggcacagctgcaggcggtggagagggaactggccgaggagcgggccaagctggagtacacggaggaggaggtcctggagatggagcgcaaggaggagcaggccgaggccatatccgagcggagttggcaagcggactcggtggatagcggctgtagcaactgcacccagaccagccctccgtacccagagccctgttgcatgggtatcgactccatcctgggccacccatttgctgctcaggcagggccttacagccccgagaaatttcagccctcgcctcttaaggttgataaggaaaccaacacggaagatctctttctggaagaagcagccagcctcgtgaaggagcggcccagccgccgggcccgagggtcgccttttgttcggagtggcacgattgtccgttcccagacattctcgcctggagcacgaagccagtatgtttgcagactttatcgtagtgacagcgacagttcaacgctgccccggaagtccccctttgtccgaaatactttggaaagacgaacccttcgctataagcagtcatgcaggtcttccctggctgagctcatggcccgcacctccctggacttggagctggatctccaggcgtcgagaacacggcagaggcagctgaatgaggagctctgcgccctccgtgagctgcggcagcggttggaggacgcccagctccgtggccagactgacctcccaccctgggtgcttcgggacgagcggctccgtggcctgctgcgggaggccgagcggcagacaagacagaccaaacttgactaccgtcatgagcaggcggctgagaagatgctgaagaaggcctccaaggagatctaccagctgcgtgggcagagccacaaagagcccatccaagtgcagacctttagggagaagatagcattcttcacaaggccaaggatcaacatacctcctctcccagccgacgacgtctgatggagtgcattgtgcacatgaagtatttatccacctgttttattttcatgaagttcttagactagctgaatttgtctttaaaatatttgtgcaaagctattaatatacacattttgtaaaaaaaaaaaaaaaacacgtatatctatacatatatattttataatagtgacggcaacagggcttggtttttccttgttgtgaaatcgacatctctgaagacaggttattttataaaagatcaactatcatgttaagaatgtacagtttttatgctgttttatttgacttaaaggctggaagacagaaacgaagtgagttcaggcaaattcactgtattgtaatttatttatagtacttttttttccttgaaggaaaatactgactttaagatgtattttaagactgaaattttgttctttagtacttttcatgcagtagaacggaacttggggctggtttggtttttgacacctgaaatgcgaacgctatgtgctaaatttgtcaccgtatcatatgtgcatttaccatgtatattgtacacattcactcccttgatgtcatgttaaaatgtcccctgcagtggttcaatcgtgactcggaagcatgtgtgtgttgcagaggtcagtctctggcgtgggccgcacgccaaccgctcatttctgtgttgcctttggaagcatctttctgtgctcagcgtgagtctgaagcaggcgccagggcctctggtgtacggggcttcagcctgcttgcttgtggtggctgtctgtggggcttcagcctgactgtccgtggtggctgtccatgctgcccgcctccccccaccccgccctgtccgactgtaacagaccaggagggtggcggaggaactcctgccacgccactgtgtcatgaaggaaagtgaaagggaacgaggaagtaggaatgcccacgctcgttgactccgtgggtgaatacagcagttaggacatacacaccatcacctttgaaagtgcttgtttgggggagggaaggacatacgggtaactagaactacccagcgagtcgtccagaggagaggatcaggtttgagtcaggaggctccctgtactggagtcgtcccactattcctcaagaaatcttagaaccagcttgtgaggaaaaacattttttaatgtaataaaaatatgccattattctttgaaatgccaaatgatataaatattttgcctaatacatatttattgtagatgaaatgcactcttctcgatgaggcctcgatttgaatcaatggggtgggccacaggaaatgtcagaggaaccagaactcagaactcttcctcctggacctttcttcccttcccttggaggtatccctttgaatcaggcctctctcttctcatcagtctgtagcttccccccttgtataacctgctttcctttttacatttattaaaagtggattttgtaaaagcatttcattgacacgcgacctatcacagacaatggaattcgtcagtggtggtaagactgaaatcctgatgcttttcacacttcttgtctcttgctatgtatttctgcctctagccttgccatgttttgccttttttttttctttttggccaattcctttttatatgtgcccacaacagaggtggggagacacggagcaccctgggtccttcccagcgctgctgggcaggccccgtctccaggccccagctgttgaaactttgaagggcaacaaacaaccatccacactgccggaccctaggctgttcagggaggcagctcatttccaccccggccccaggacacccagcctgtgccccacaaggatctctctaaatgggagggattgaggctacttttctgccaagccctattaagtagtaatgtggggaaacccactgtgtcagtgcaggaagccctagacaaatgttttcaaataaatttcactgcccagcctgcacagatttccatttgaagtacttcccatccaccctgacacccaaaggggtttttttgttttgttttgtttttgagacagggtcttgctttgttgcccaggctggagtgcagtgacgtggtcatagctcactgcagcctcaacctcctgggctcaagtgaccctcctgcctcagcctcccaaagttctgagatgataggcatgagccattgtgcctagcctattttgatttttttcttagagtcaaggtcttgctctgttgcccaggctgatcttggacttgcgagccaccatgcctggctgggttttttaaaaatagaatctcactgatagcctgcaagaaacagatgcagtgcctgcttccgtatcagtccaaggagccctcgtgtttgccacctttacctttgaacctccccctgcctccctgcctgtgtccgcttttgcagctcaatgcagccatgacaaggaaagaaaagacaaaggaaggccagagagccgcgcagttctctgcaggtgcagatgcaggcagtggaggtggcctgagcaggcagaaggacaccaagcgccctatgttgcttgtcattcatgacgtggtcttggagcttctgactagttcagactgccacgccaaccccagaaaataccccacatgccagaaaagtgaagtcctaggtgtttccatctatgtttcaatctgtccatctaccaggcctcgcgataaaaacaaaacaaaaaaacgctgccaggttttagaagcagttctggtctcaaaaccatcaggatcctgccaccagggttcttttgaaatagtaccacatgtaaaagggaatttggctttcacttcatctaatcactgaattgtcaggctttgattgataattgtagaaataagtagccttctgttgtgggaataagttataatcagtattcatctctttgttttttgtcactcttttctctctaattgtgtcatttgtactgtttgaaaaatatttcttctataaaattaaactaacctgccttaa

SEQ ID NO: 335034 - DNA, 3658 bp, Homo sapiens
gcggccgcccccgcgccccgggcgccgggccttagtgctggcgcgggcccgggagagcgccgagctgccgctgcccgccggctgggaggaggcgcgagactacgacggtcgcgtcttttacattgaccacaacacgcgccagacgtcgtggatcgacccccgcgaccggataacaaagccattgacctttgccgattgtgttggggacgaacttcctttaggatgggaaaccgtatatgataaacaaattggagtttattacatggaccacataaataaacttacccagattgaggatccaagagaacagtggaggcgagagcaagagcgcatgttgaaggaatatttaattgtagctcaggaggctctcaatgccaagaaagaaatctaccagattaagcagcagcggttcgagctggcccaggaggaataccagcagctgcacaaaatgtgtgaggatgacagccgctcgtacgccagctcattctctggatattcaacaaatacaaagtatgacccacaccaaattaaagcagaaatagcaagtcgtcgggataggctttccagattaaaacgagagctgacccagatgaagcaggaactgcagtacaaagaaaagggggtggagaccctgcaagagattgatcggaagatgtcaagtactcacaccagctacaaactggatgaggcgcaggctatcatgagtgagctccggaccatcaagaaggccatttgcacaggcgagaaggagaggcgggacctgatgcatagcctggccaagctgaccgatagcttcaagaacagctgctccgttaccgactctctagtggacttccctcaccatgtaggcgtgcctggcgatgctggtgtaccccagcagttctgcgatgccggctcccagactgatatcatcggggagtttgtctttgatgataaaacaagacttgtagaccgagtcagacttaattggcaatatgaagaagccagaaagagagtcgccaacatccagcagcagctggcccggcttgacaatgagtcctggccaagcacggccgaggctgacagggaccggctgcagctcatcaaggagaaggaggccctgctgcaggagcttcagctcatcattgcacagcgccgctctgcgggagatgtggcccggctggaggaggagcgggagcgcctagaggaggagctgcggcgtgcacgggccacctccgcacagggcgccacggagaggattctgcttcaggaaaaaaggaattgtctacttatgcagctggaagaagccacccgcttaacatcctacctccagtcccagttaaaaagcctgtgtgccagcaccctgacggtgtcctcggggagcagccgcgggtccctagcctccagccgtgggtctctggcctccagccggggctccctgagctcggtcagcttcacggacatctacggcctcccgcagtacgagaagcccgacgctgagggcagccagcttctacgcttcgacctcattcccttcgactctctggggcgagatgctcccttttcagagcccccaggcccctcgggcttccacaagcagaggcggtccctggacacgccccagtccctggcatcgctgtcctcccgctcctcgctgtcctcgctgtcgcccccaagctcgcccctggacacgcccttcctccctgcctcacgggactcgccgctggcgcagctggcggacagctgtgaggggccaggcctgggcgccctagacagactgcgggcacacgcctcggctatgggggacgaagacttaccaggcatggcggcccttcagccacacggggtccccggggacggggaagggccgcacgagcgaggacccccaccagccagcgctcccgtgggtggaacagtgactcttcgagaagacagtgccaagaggttggagaggagggcacgccgcatctccgcatgtctgtcggattattcgctagccagcgacagtggggtgtttgaacctctaaccaaaaggaacgaagatgccgaggagcctgcctacggagacacggccagtaacggagatccccagatccacgtgggactcctgcgcgacagtggcagcgagtgtctcctcgtgcacgtgctgcagctgaagaacccggcggggctggcggtgaaggaagactgcaaagtccacatccgagtctatttgcccccactggactcgggcacgcccaacacttactgctccaaggctctggagttccaagtgccgctggtgtttaacgaagtgttcagaatccccgtgcattccagcgcgttgacactgaagtcacttcagttatacgtgtgttcagtgactccgcagctgcaggaagaactgctgggcattgctcagattaacctggctgactatgacagtttgagtgagatgcagctgcgctggcattccgtgcaggtgttcaccagctctgaaccatcaaggacgcgggaggctgggtgtgcaggagagagctccgcccgggaccctgcacacaccatctccatctccggcaagacggatgcggtgacggtgctcctggccagaaccacggcacagctgcaggcggtggagagggaactggccgaggagcgggccaagctggagtacacggaggaggaggtcctggagatggagcgcaaggaggagcaggccgaggccatatccgagcggagttggcaagcggactcggtggatagcggctgtagcaactgcacccagaccagccctccgtacccagagccctgttgcatgggtatcgactccatcctgggccacccatttgctgctcaggcagggccttacagccccgagaaatttcagccctcgcctcttaaggttgataaggaaaccaacacggaagatctctttctggaagaagcagccagcctcgtgaaggagcggcccagccgccgggcccgagggtcgccttttgttcggagtggcacgattgtccgttcccagacattctcgcctggagcacgaagccagtatgtttgcagactttatcgtagtgacagcgacagttcaacgctgccccggaagtccccctttgtccgaaatactttggaaagacgaacccttcgctataagcagtcatgcaggtcttccctggctgagctcatggcccgcacctccctggacttggagctggatctccaggcgtcgagaacacggcagaggcagctgaatgaggagctctgcgccctccgtgagctgcggcagcggttggaggacgcccagctccgtggccagactgacctcccaccctgggtgcttcgggacgagcggctccgtggcctgctgcgggaggccgagcggcagacaagacagaccaaacttgactaccgtcatgagcaggcggctgagaagatgctgaagaaggcctccaaggagatctaccagctgcgtgggcagagccacaaagagcccatccaagtgcagacctttagggagaagatagcattcttcacaaggccaaggatcaacatacctcctctcccagccgacgacgtctgatggagtgcattgtgcacatgaagtatttatccacctgttttattttcatgaagttcttagactagctgaatttgtctttaaaatatttgtgcaaagctattaatatacacattttgt

SEQ ID NO: 335035 - DNA, 5609 bp, Homo sapiens
gcggccgcccccgcgccccgggcgccgggccttagtgctggcgcgggcccgggagagcgccgagctgccgctgcccgccggctgggaggaggcgcgagactacgacggtcgcgtcttttacattgaccacaacacgcgccagacgtcgtggatcgacccccgcgaccggataacaaagccattgacctttgccgattgtgttggggacgaacttcctttaggatgggaaaccgtatatgataaacaaattggagtttattacatggaccacataaataaacttacccagattgaggatccaagagaacagtggaggcgagagcaagagcgcatgttgaaggaatatttaattgtagctcaggaggctctcaatgccaagaaagaaatctaccagattaagcagcagcggttcgagctggcccaggaggaataccagcagctgcacaaaatgtgtgaggatgacagccgctcgtacgccagctcattctctggatattcaacaaatacaaagtatgacccacaccaaattaaagcagaaatagcaagtcgtcgggataggctttccagattaaaacgagagctgacccagatgaagcaggaactgcagtacaaagaaaagggggtggagaccctgcaagagattgatcggaagatgtcaagtactcacaccagctacaaactggatgaggcgcaggctatcatgagtgagctccggaccatcaagaaggccatttgcacaggcgagaaggagaggcgggacctgatgcatagcctggccaagctgaccgatagcttcaagaacagctgctccgttaccgactctctagtggacttccctcaccatgtaggcgtgcctggcgatgctggtgtaccccagcagttctgcgatgccggctcccagactgatatcatcggggagtttgtctttgatgataaaacaagacttgtagaccgagtcagacttaattggcaatatgaagaagccagaaagagagtcgccaacatccagcagcagctggcccggcttgacaatgagtcctggccaagcacggccgaggctgacagggaccggctgcagctcatcaaggagaaggaggccctgctgcaggagcttcagctcatcattgcacagcgccgctctgcgggagatgtggcccggctggaggaggagcgggagcgcctagaggaggagctgcggcgtgcacgggccacctccgcacagggcgccacggagaggattctgcttcaggaaaaaaggaattgtctacttatgcagctggaagaagccacccgcttaacatcctacctccagtcccagttaaaaagcctgtgtgccagcaccctgacggtgtcctcggggagcagccgcgggtccctagcctccagccgtgggtctctggcctccagccggggctccctgagctcggtcagcttcacggacatctacggcctcccgcagtacgagaagcccgacgctgagggcagccagcttctacgcttcgacctcattcccttcgactctctggggcgagatgctcccttttcagagcccccaggcccctcgggcttccacaagcagaggcggtccctggacacgccccagtccctggcatcgctgtcctcccgctcctcgctgtcctcgctgtcgcccccaagctcgcccctggacacgcccttcctccctgcctcacgggactcgccgctggcgcagctggcggacagctgtgaggggccaggcctgggcgccctagacagactgcgggcacacgcctcggctatgggggacgaagacttaccaggcatggcggcccttcagccacacggggtccccggggacggggaagggccgcacgagcgaggacccccaccagccagcgctcccgtgggtggaacagtgactcttcgagaagacagtgccaagaggttggagaggagggcacgccgcatctccgcatgtctgtcggattattcgctagccagcgacagtggggtgtttgaacctctaaccaaaaggaacgaagatgccgaggagcctgcctacggagacacggccagtaacggagatccccagatccacgtgggactcctgcgcgacagtggcagcgagtgtctcctcgtgcacgtgctgcagctgaagaacccggcggggctggcggtgaaggaagactgcaaagtccacatccgagtctatttgcccccactggactcgggcacgcccaacacttactgctccaaggctctggagttccaagtgccgctggtgtttaacgaagtgttcagaatccccgtgcattccagcgcgttgacactgaagtcacttcagttatacgtgtgttcagtgactccgcagctgcaggaagaactgctgggcattgctcagattaacctggctgactatgacagtttgagtgagatgcagctgcgctggcattccgtgcaggtgttcaccagctctgaaccatcaaggacgcgggaggctgggtgtgcaggagagagctccgcccgggaccctgcacacaccatctccatctccggcaagacggatgcggtgacggtgctcctggccagaaccacggcacagctgcaggcggtggagagggaactggccgaggagcgggccaagctggagtacacggaggaggaggtcctggagatggagcgcaaggaggagcaggccgaggccatatccgagcggagttggcaagcggactcggtggatagcggctgtagcaactgcacccagaccagccctccgtacccagagccctgttgcatgggtatcgactccatcctgggccacccatttgctgctcaggcagggccttacagccccgagaaatttcagccctcgcctcttaaggttgataaggaaaccaacacggaagatctctttctggaagaagcagccagcctcgtgaaggagcggcccagccgccgggcccgagggtcgccttttgttcggagtggcacgattgtccgttcccagacattctcgcctggagcacgaagccagtatgtttgcagactttatcgtagtgacagcgacagttcaacgctgccccggaagtccccctttgtccgaaatactttggaaagacgaacccttcgctataagcagtcatgcaggtcttccctggctgagctcatggcccgcacctccctggacttggagctggatctccaggcgtcgagaacacggcagaggcagctgaatgaggagctctgcgccctccgtgagctgcggcagcggttggaggacgcccagctccgtggccagactgacctcccaccctgggtgcttcgggacgagcggctccgtggcctgctgcgggaggccgagcggcagacaagacagaccaaacttgactaccgtcatgagcaggcggctgagaagatgctgaagaaggcctccaaggagatctaccagctgcgtgggcagagccacaaagagcccatccaagtgcagacctttagggagaagatagcattcttcacaaggccaaggatcaacatacctcctctcccagccgacgacgtctgatggagtgcattgtgcacatgaagtatttatccacctgttttattttcatgaagttcttagactagctgaatttgtctttaaaatatttgtgcaaagctattaatatacacattttgtaaaaaaaaaaaaaaaacacgtatatctatacatatatattttataatagtgacggcaacagggcttggtttttccttgttgtgaaatcgacatctctgaagacaggttattttataaaagatcaactatcatgttaagaatgtacagtttttatgctgttttatttgacttaaaggctggaagacagaaacgaagtgagttcaggcaaattcactgtattgtaatttatttatagtacttttttttccttgaaggaaaatactgactttaagatgtattttaagactgaaattttgttctttagtacttttcatgcagtagaacggaacttggggctggtttggtttttgacacctgaaatgcgaacgctatgtgctaaatttgtcaccgtatcatatgtgcatttaccatgtatattgtacacattcactcccttgatgtcatgttaaaatgtcccctgcagtggttcaatcgtgactcggaagcatgtgtgtgttgcagaggtcagtctctggcgtgggccgcacgccaaccgctcatttctgtgttgcctttggaagcatctttctgtgctcagcgtgagtctgaagcaggcgccagggcctctggtgtacggggcttcagcctgcttgcttgtggtggctgtctgtggggcttcagcctgactgtccgtggtggctgtccatgctgcccgcctccccccaccccgccctgtccgactgtaacagaccaggagggtggcggaggaactcctgccacgccactgtgtcatgaaggaaagtgaaagggaacgaggaagtaggaatgcccacgctcgttgactccgtgggtgaatacagcagttaggacatacacaccatcacctttgaaagtgcttgtttgggggagggaaggacatacgggtaactagaactacccagcgagtcgtccagaggagaggatcaggtttgagtcaggaggctccctgtactggagtcgtcccactattcctcaagaaatcttagaaccagcttgtgaggaaaaacattttttaatgtaataaaaatatgccattattctttgaaatgccaaatgatataaatattttgcctaatacatatttattgtagatgaaatgcactcttctcgatgaggcctcgatttgaatcaatggggtgggccacaggaaatgtcagaggaaccagaactcagaactcttcctcctggacctttcttcccttcccttggaggtatccctttgaatcaggcctctctcttctcatcagtctgtagcttccccccttgtataacctgctttcctttttacatttattaaaagtggattttgtaaaagcatttcattgacacgcgacctatcacagacaatggaattcgtcagtggtggtaagactgaaatcctgatgcttttcacacttcttgtctcttgctatgtatttctgcctctagccttgccatgttttgccttttttttttctttttggccaattcctttttatatgtgcccacaacagaggtggggagacacggagcaccctgggtccttcccagcgctgctgggcaggccccgtctccaggccccagctgttgaaactttgaagggcaacaaacaaccatccacactgccggaccctaggctgttcagggaggcagctcatttccaccccggccccaggttttagaagcagttctggtctcaaaaccatcaggatcctgccaccagggttcttttgaaatagtaccacatgtaaaagggaatttggctttcacttcatctaatcactgaattgtcaggctttgattgataattgtagaaataagtagccttctgttgtgggaataagttataatcagtattcatctctttgttttttgtcactcttttctctctaattgtgtcatttgtactgtttgaaaaatatttcttctataaaattaaactaacctgccttaa

SEQ ID NO: 335036 - DNA, 542 bp, Homo sapiens
  misc_feature (115)..(115): n is a, c, g, or t
  misc_feature (139)..(139): n is a, c, g, or t
  misc_feature (174)..(174): n is a, c, g, or t
  misc_feature (179)..(179): n is a, c, g, or t
  misc_feature (184)..(185): n is a, c, g, or t
  misc_feature (188)..(188): n is a, c, g, or t
atgtggggtaatttgttatgtagcaacagataaggaatgaaatgaccctgccatttatcattgagatgggaataaactttttttagaatagcaggaagtactttaaataattacnggcgtgagccaccactcccggccngaatctttcttgatcagatgtcttctgtctatccncctgnccgcnnacngtacggatgtgcgggccagtacggatgggtatggactctgggatctctcattctaagtcccacactgggacccaggggattacacaagcccagttgggcagcaaaaatttctgtgctcaccaagagacgaacagacagttcccagttaactgagaaaagggaatagaaatgacgaggcagacattcagcctcattcataacagaaatgcaaacagaactacagtgaggtacccctgtaagctactggactggcaaaaacaaagcagaggtacggagagggcaatcccagcatctgagataggagtctaaaccagcataacctccagatccgtactggcctggggtaccgagctc

SEQ ID NO: 335037 - DNA, 128 bp, Homo sapiens
tgtgctaaataaatgatcaacaagctaacatcttagtcatcacaggaaaaacatgttcaaacaataagaaactcctaacttctcagacaatcctcactcccccaacacatttcaactggtttcttcag

SEQ ID NO: 335038 - DNA, 634 bp, Homo sapiens
ggacgctggagcagagtgtcggggagtggctggagtcgattgggctgcagcagtatgagagcaagttgcttctgaatggctttgacgatgtccacttcctggggtctaatgtgatggaagagcaggacctgcgggacatcggcatcagcgacccacagcaccggcggaagctgctccaggcggcacgctccctacccaaggtgaaggctctgggttatgacgggaacagcccccctagcgtgccctcctggctggactccctggggctgcaggactacgtccattccttcttgtcaagtggttacagctccattgacaccgtgaagaacctctgggagctagagctcgtcaatgtcctgaaggtccagctgctcggccatcgcaagcgcatcatcgcctccctcgcagacagaccgtacgaggagccgccccagaagccccccagattctcccagctgaggtgccaagatttgctctcccagacgtcatccccactgagtcagaatgattcctgcactgggcggtcggcagatctgctgctgcctccaggggacacaggcaggaggcgccatgacagtctccatgaccctgcggcaccctcccgagcggagcgcttcaggatccaggtggggca

SEQ ID NO: 335039 - DNA, 114 bp, Homo sapiens
taagtgggactcaggaacaacaccctccgcctccacaaaaaaacaaaaataatccaatcaggaagagggccactcatgggtacagactggcggcagatgctccagcaagtttga

SEQ ID NO: 335040 - DNA, 2166 bp, Homo sapiens
cgattttccaagcagctttgccgcgcggtgttttctaaagcggggcgtgggctgggtgcccttttgggcctcacttgtccggcctgcggcaagtgctgggcgatgggatgcggttctggcggcaaaggaagggctgcctttgagagtcccgcaggaaggtttagaaagtgattgttcttaaaacaaacagagcgttttgctgtgtgttcctcaaagtggtcccggtgggagtggcgcctcattgtgagctgtgccttatctgatgaattaatggcaggtgaaagccttgcgcctccggagcgaatatttacgacttttgaaaatgtctttaatgtctaaaaaaagtcttttagaaaatcagacggcctcttgttcttatgttatcaagagtttagatttctgtggtaaatataagtgagtttcattttaagtaaactcattttacgagatttgagatttgaaagtgaaattaattaattttgcacaatctagccttgggctctgagaaaatgttgtaaagctgtaattaatcttgtgggacgaagtgaaaaggaactaaagtgtatggtgtaatgaatagtttaaatttctgtggtaaatacaagtgagtttcattttaagtaaactcatttttatgggatttgagatttaaaagtgaaattaattaatttcgcacaatctagtcatggttgggctcagaaaatgttgtaaagttgtgatttatcttatggaaagaagtgaaaaggaattaaggtatatggtgtaattaagagtttaaatttctgtggtaaatgcaagtgagtttcattttaagtaaactcatttttacgggatttgagatttaaaagtgaaattaattcattttgcacagtgtagtcatggttgggctctgagaaaatgttgtaaagctgaaattatttatcttgtgggaagaagtgagaagaaactaaaatgtgtggtattatcaagagtttagatttccggggtaaatataaatgagtttcctttaaactcatttttgtggaatttgaggtttaaaagtgaaattaattttgtagaatctagtcatggttgggctctgagaaaatgttgtaaagctgtaatttatcttgtgggaaaaagtgaaaaggaacttaaatttatggtgttatcaagaattggccaggcgcggtggctcacacctgtaatcccagcactttgggaggccgaggtgggcagatcacttgaggtcagaagttcgggaccagcctggccaacatggtgaaacccagtctttactaaaagtacaaaaattaactgggcatggtggtgcaagcctgttacgctaactactcgggaggctgagggaggagaattgctttaacccgggaggcagaggttgcagtaagccgagatcatgccactgcactccagcctgggtgacagagtaagactctgtctcaaaaaaaaaaaaaaaaaaaaaagaaatttagatttctgtggtaaatataaatgagtttcattttaagtaaactcattttgtgggatttgagatttaaaaatgaaattaattttgcacattctagtcatggttgggctctaaggcaatgttgtaaagctgtaattgtttgccttatgggaagaagtgaaaaggaattaaaatttatggtgtgtctactatgaaccaggcatgatgctgagagtttaactgtgtaatttttggcctaaatagccctgtgaagtagatattattccaactttacaggttagaaaatttgaggcacagagaggtgaaatatttgcctaaagtgaaacggcaaatttggcaatttggacttggattcaagtgtttataactaaagcccagctccttgcatcataccctggtacctaaaagacataaaaactcacttcaggtgcaatgtgaatgaaaatgacgttatgacccaggcttgttgtctatgtgctccttgagaaatagttctgttggatagatgcggtcaatactcaaaagcccttgctatctttgccatgcattactctaagcacttgacatgtattaatttaatcctcacgattccgtgaggtatgtgctattatcattcccatttcaaaaaaaaacacttcctatctctctacctcctctcttctccttctctaccctctccgactcttcctcgaccatta

SEQ ID NO: 335041 - DNA, 2112 bp, Homo sapiens
cgattttccaagcagctttgccgcgcggtgttttctaaagcggggcgtgggctgggtgcccttttgggcctcacttgtccggcctgcggcaagtgctgggcgatgggatgcggttctggcggcaaaggaagggctgcctttgagagtcccgcaggaaggtttagaaagtgattgttcttaaaacaaacagagcgttttgctgtgtgttcctcaaagtggtcccggtgggagtggcgcctcattgtgagctgtgccttatctgatgaattaatggcaggtgaaagccttgcgcctccggagcgaatatttacgacttttgaaaatgtctttaatgtctaaaaaaagtcttttagaaaatcagacggcctcttgttcttatgttatcaagagtttagatttctgtggtaaatataagtgagtttcattttaagtaaactcattttacgagatttgagatttgaaagtgaaattaattaattttgcacaatctagccttgggctctgagaaaatgttgtaaagctgtaattaatcttgtgggacgaagtgaaaaggaactaaagtgtatggtgtaatgaatagtttaaatttctgtggtaaatacaagtgagtttcattttaagtaaactcatttttatgggatttgagatttaaaagtgaaattaattaatttcgcacaatctagtcatggttgggctcagaaaatgttgtaaagttgtgatttatcttatggaaagaagtgaaaaggaattaaggtatatggtgtaattaagagtttaaatttctgtggtaaatgcaagtgagtttcattttaagtaaactcatttttacgggatttgagatttaaaagtgaaattaattcattttgcacagtgtagtcatggttgggctctgagaaaatgttgtaaagctgaaattatttatcttgtgggaagaagtgagaagaaactaaaatgtgtggtattatcaagagtttagatttccggggtaaatataaatgagtttcctttaaactcatttttgtggaatttgaggtttaaaagtgaaattaattttgtagaatctagtcatggttgggctctgagaaaatgttgtaaagctgtaatttatcttgtgggaaaaagtgaaaaggaacttaaatttatggtgttatcaagaattggccaggcgcggtggctcacacctgtaatcccagcactttgggaggccgaggtgggcagatcacttgaggtcagaagttcgggaccagcctggccaacatggtgaaacccagtctttactaaaagtacaaaaattaactgggcatggtggtgcaagcctgttacgctaactactcgggaggctgagggaggagaattgctttaacccgggaggcagaggttgcagtaagccgagatcatgccactgcactccagcctgggtgacagagtaagactctgtctcaaaaaaaaaaaaaaaaaaaaaagaaatttagatttctgtggtaaatataaatgagtttcattttaagtaaactcattttgtgggatttgagatttaaaaatgaaattaattttgcacattctagtcatggttgggctctaaggcaatgttgtaaagctgtaattgtttgccttatgggaagaagtgaaaaggaattaaaatttatggtgtgtctactatgaaccaggcatgatgctgagagtttaactgtgtaatttttggcctaaatagccctgtgaagtagatattattccaactttacaggttagggcaatttggacttggattcaagtgtttataactaaagcccagctccttgcatcataccctggtacctaaaagacataaaaactcacttcaggtgcaatgtgaatgaaaatgacgttatgacccaggcttgttgtctatgtgctccttgagaaatagttctgttggatagatgcggtcaatactcaaaagcccttgctatctttgccatgcattactctaagcacttgacatgtattaatttaatcctcacgattccgtgaggtatgtgctattatcattcccatttcaaaaaaaaacacttcctatctctctacctcctctcttctccttctctaccctctccgactcttcctcgaccatta

SEQ ID NO: 335042 - DNA, 2921 bp, Homo sapiens
gcagtcagcagaggagagcgccaggacgctacagcagctgaagaggcagtggcgcccgcggccgcggcgtcggggctggagcgatggcggcgaccgcggtggcggcggctgtggcgggaaccgagtcggcccagggtcccccgggcccggcagcgtcgctggagctgtggctgaacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacggtgctggagatgtgcatgaaccactgtgggagaagttccacagcgaggtggccaaatttcgtttcctgaacgaactgatcaaagtgttgtccccaaagtacctgtggtcctgggccacaggaaaagttaaaggaagagtcattgatatactcttcacttggacagtctggtttccggaagacatcaagattcgagacgcttatcacatgctgaacaaacaaggaattattaaacaagaccctaaactaccagtggataaaatcttacccccaccatctccctggcccaagagctccatctttgatgctgatgaagaaaagtccaagcttctgacaaggcttctaaagagcaaccaccccgaggaccttcaggctgcaaaccggttaatcaagaatttggtcaaggaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcaccacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactgtggtacagatagacatgaagagagcttagcagtgattgaggtggtgactaaatatacagtcattgaataaataccatgtagcaagtgt

SEQ ID NO: 335043 - DNA, 5192 bp, Homo sapiens
gcagtcagcagaggagagcgccaggacgctacagcagctgaagaggcagtggcgcccgcggccgcggcgtcggggctggagcgatggcggcgaccgcggtggcggcggctgtggcgggaaccgagtcggcccagggtcccccgggcccggcagcgtcgctggagctgtggctgaacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacggtgctggagatgtgcatgaaccactgtgggagaagttccacagcgaggtggccaaatttcgtttcctgaacgaactgatcaaagtgttgtccccaaagtacctgtggtcctgggccacaggaaaagttaaaggaagagtcattgatatactcttcacttggacagtctggtttccggaagacatcaagattcgagacgcttatcacatgctgaacaaacaaggaattattaaacaagaccctaaactaccagtggataaaatcttacccccaccatctccctggcccaagagctccatctttgatgctgatgaagaaaagtccaagcttctgacaaggcttctaaagagcaaccaccccgaggaccttcaggctgcaaaccggttaatcaagaatttggtcaaggaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcaccacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactgtggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatgtcagctcactgcaatctctgcctaccaggttcaagcgattctcgtgcctcagcctctcgagtagctggggactacaggcgtgacaggcacgcccagctaatttttgtatttttagtaggagacaggatttcaccatgttggccagggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctataatcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccctga

SEQ ID NO: 335044 - DNA, 4607 bp, Homo sapiens
gcagtcagcagaggagagcgccaggacgctacagcagctgaagaggcagtggcgcccgcggccgcggcgtcggggctggagcgatggcggcgaccgcggtggcggcggctgtggcgggaaccgagtcggcccagggtcccccgggcccggcagcgtcgctggagctgtggctgaacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacggtgctggagatgtgcatgaaccactgtgggagaagttccacagcgaggtggccaaatttcgtttcctgaacgaactgatcaaagtgttgtccccaaagtacctgtggtcctgggccacaggaaaagttaaaggaagagtcattgatatactcttcacttggacagtctggtttccggaagacatcaagattcgagacgcttatcacatgctgaacaaacaaggaattattaaacaagaccctaaactaccagtggataaaatcttacccccaccatctccctggcccaagagctccatctttgatgctgatgaagaaaagtccaagcttctgacaaggcttctaaagagcaaccaccccgaggaccttcaggctgcaaaccggttaatcaagaatttggtcaaggaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcaccacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactgtggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatgtcagctcactgcaatctctgcctaccaggttcaagcgattctcgtgcctcagccccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccctga

SEQ ID NO: 335045 - DNA, 4679 bp, Homo sapiens
gcagtcagcagaggagagcgccaggacgctacagcagctgaagaggcagtggcgcccgcggccgcggcgtcggggctggagcgatggcggcgaccgcggtggcggcggctgtggcgggaaccgagtcggcccagggtcccccgggcccggcagcgtcgctggagctgtggctgaacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacggtgctggagatgtgcatgaaccactgtgggagaagttccacagcgaggtggccaaatttcgtttcctgaacgaactgatcaaagtgttgtccccaaagtacctgtggtcctgggccacaggaaaagttaaaggaagagtcattgatatactcttcacttggacagtctggtttccggaagacatcaagattcgagacgcttatcacatgctgaacaaacaaggaattattaaacaagaccctaaactaccagtggataaaatcttacccccaccatctccctggcccaagagctccatctttgatgctgatgaagaaaagtccaagcttctgacaaggcttctaaagagcaaccaccccgaggaccttcaggctgcaaaccggttaatcaagaatttggtcaaggaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcaccacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactgtggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatgtcagctcactgcaatctctgcctaccaggttcaagcgattctcgtgcctcagcctctcgagtagctggggactacaggcgtgacaggcacgcccagctaatttttgtatttttagtaggagacagcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccctga

SEQ ID NO: 335046 - DNA, 5410 bp, Homo sapiens
gcagtcagcagaggagagcgccaggacgctacagcagctgaagaggcagtggcgcccgcggccgcggcgtcggggctggagcgatggcggcgaccgcggtggcggcggctgtggcgggaaccgagtcggcccagggtcccccgggcccggcagcgtcgctggagctgtggctgaacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacggtgctggagatgtgcatgaaccactgtgggagaagttccacagcgaggtggccaaatttcgtttcctgaacgaactgatcaaagtgttgtccccaaagtacctgtggtcctgggccacaggaaaagttaaaggaagagtcattgatatactcttcacttggacagtctggtttccggaagacatcaagattcgagacgcttatcacatgctgaacaaacaaggaattattaaacaagaccctaaactaccagtggataaaatcttacccccaccatctccctggcccaagagctccatctttgatgctgatgaagaaaagtccaagcttctgacaaggcttctaaagagcaaccaccccgaggaccttcaggctgcaaaccggttaatcaagaatttggtcaaggaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcaccacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactgtggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatgtcagctcactgcaatctctgcctaccaggttcaagcgattctcgtgcctcagcctctcgagtagctggggactacaggcgtgacaggcacgcccagctaatttttgtatttttagtaggagacaggatttcaccatgttggccagggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctataatcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacaggttgcacgctggcactcagtgcccttctggtatcatctgccaagaccagggcctgcttcaccacagccacaataaagtcctttcaagccctgataatgccatgttttgtcctaaccttttgctgcagttaattactcttcctattatcttccatgaacttaagactgggcaaaaatgtttccttatctgtgagccactctgaacacaaacaggtcatgaagatagtgttgaaaacaataaatgacaaccaaaagaaaagtgaatattacctagtacaaatagtgtaaattgagacagaaaatgttaaagctagaaagcaagggcaatattctagaatacaaatagtgcttgcctactacaatatt

SEQ ID NO: 335047 - DNA, 2537 bp, Homo sapiens
tgaagtttcctggacttctcaaccgaagacagttccctttaggcctatcatctccatcctcatcctcttccttcacagcatttacttggagctctttgtgacacaccatgtcagtcatgatgaatcggccaacagccagcccttgccagctgacgtcacagtctaagatgggaaactgtggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatgtcagctcactgcaatctctgcctaccaggttcaagcgattctcgtgcctcagcctctcgagtagctggggactacaggcgtgacaggcacgcccagctaatttttgtatttttagtaggagacaggatttcaccatgttggccagggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctataatcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccctga

SEQ ID NO: 335048 - DNA, 2448 bp, Homo sapiens
gctgttctagaggatcccttagtcacagctcacatcactgctaagctctcttcatgtctatctgtaccacagtttcccatcttagactgtggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatgtcagctcactgcaatctctgcctaccaggttcaagcgattctcgtgcctcagcctctcgagtagctggggactacaggcgtgacaggcacgcccagctaatttttgtatttttagtaggagacaggatttcaccatgttggccagggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctataatcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccctga

SEQ ID NO: 335049 - DNA, 4756 bp, Homo sapiens
gcagtcagcagaggagagcgccaggacgctacagcagctgaagaggcagtggcgcccgcggccgcggcgtcggggctggagcgatggcggcgaccgcggtggcggcggctgtggcgggaaccgagtcggcccagggtcccccgggcccggcagcgtcgctggagctgtggctgaacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacggtgctggagatgtgcatgaaccactgtgggagaagttccacagcgaggtggccaaatttcgtttcctgaacgaactgatcaaagtgttgtccccaaagtacctgtggtcctgggccacaggaaaagttaaaggaagagtcattgatatactcttcacttggacagtctggtttccggaagacatcaagattcgagacgcttatcacatgctgaacaaacaaggaattattaaacaagaccctaaactaccagtggataaaatcttacccccaccatctccctggcccaagagctccatctttgatgctgatgaagaaaagtccaagcttctgacaaggcttctaaagagcaaccaccccgaggaccttcaggctgcaaaccggttaatcaagaatttggtcaaggaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcaccacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactgtggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatgtcagctcactgcaatctctgcctaccaggttcaagcgattctcgtgcctcagcctctcgagtagctggggactacaggcgtgacaggcacgcccagctaatttttgtatttttagtaggagacaggatttcaccatgttggccagggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctataatgcaggagaatggcgtgagcccgggaggcggagcttgcagtgagccgagatagcgccactgcactccagcctgggcgacagagcgagactccgtctcaaaaaaaaaaaaaaaaaaaaaaaaaaaaaaggggggccgttcggggcccccccattctttgcttttttttttgttaaacacccaagcccgtgtgaccccttaaggggggccctatctaagcccttctttaagtgaccttcggggggcctattgcccagtggtgtatttgtccgctttctccagtctccattaaggccttccttcaattaatgagggccttatataaccaaacgactcttaaccattattcccacgtggagtgagcgaggttaacagcgagaaaaggcccattacaagggccacccagatcacacgcgtgtccaaaagggctcggagagggaaaaacccgatttttttctctcacaggtttttcttgccaggattttctgacctttaccatcg

SEQ ID NO: 335050 - DNA, 2045 bp, Homo sapiens
ggaattcaagttaacaattccacttaggccacttggcaggacttgattggatgttgaagcctctggcctatggtggaaggacctacctgctaatgctagcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatgtcagctcactgcaatctctgcctaccaggttcaagcgattctcgtgcctcagcctctcgagtagctggggactacaggcgtgacaggcacgcccagctaatttttgtatttttagtaggagacaggatttcaccatgttggccagggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctataatcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccctga

SEQ ID NO: 335051 - DNA, 1124 bp, Homo sapiens
cctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcggggtggtgcccccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccctga

SEQ ID NO: 335052 - DNA, 506 bp, Homo sapiens
atcccgagggtggaggtgaagcagggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccctga

SEQ ID NO: 335053 - DNA, 5464 bp, Homo sapiens
gcagtcagcagaggagagcgccaggacgctacagcagctgaagaggcagtggcgcccgcggccgcggcgtcggggctggagcgatggcggcgaccgcggtggcggcggctgtggcgggaaccgagtcggcccagggtcccccgggcccggcagcgtcgctggagctgtggctgaacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacggtgctggagatgtgcatgaaccactgtgggagaagttccacagcgaggtggccaaatttcgtttcctgaacgaactgatcaaagtgttgtccccaaagtacctgtggtcctgggccacaggaaaagttaaaggaagagtcattgatatactcttcacttggacagtctggtttccggaagacatcaagattcgagacgcttatcacatgctgaacaaacaaggaattattaaacaagaccctaaactaccagtggataaaatcttacccccaccatctccctggcccaagagctccatctttgatgctgatgaagaaaagtccaagcttctgacaaggcttctaaagagcaaccaccccgaggaccttcaggctgcaaaccggttaatcaagaatttggtcaaggaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcaccacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactgtggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatgtcagctcactgcaatctctgcctaccaggttcaagcgattctcgtgcctcagcctctcgagtagctggggactacaggcgtgacaggcacgcccagctaatttttgtatttttagtaggagacaggatttcaccatgttggccagggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctataatcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccctgataatgccatgttttgtcctaaccttttgctgcagttaattactcttcctattatcttccatgaacttaagactgggcaaaaatgtttccttatctgtgagccactctgaacacaaacaggtcatgaagatagtgttgaaaacaataaatgacaaccaaaagaaaagtgaatattacctagtacaaatagtgtaaattgagacagaaaatgttaaagctagaaagcaagggcaatattctagaatacaaatagtgcttgcctactacaatatt

SEQ ID NO: 335054 - DNA, 117 bp, Homo sapiens
cctctatgcgctatttttcctttctaccgtctcccgccagtaaacctgccttgtccatttcaggacaattccagctgcaactggacacatcacggaaatgacatcagtgccttactg

SEQ ID NO: 335055 - DNA, 134 bp, Homo sapiens
tgtccagaaataagaataacacaatagctaatcacaaaatttaataatattatgtttttagagacagggtctcgttgtgtcacccaggctggagagcaaaggcgcaatcacaactcactgcagcctccaactct

SEQ ID NO: 335056 - DNA, 353 bp, Homo sapiens
atggccagagtaggagaaagagagagaggggaggtgccacacacttttaaacaaccagatcgcatgagaactcactcactatacagtaccaaggggggaccgtgctaaaccattcataagaactctgcccccatgacccaatcacctcccaccaggccccacctccaacactggggattacgattcgacatgagatttgggcagggacgacatccaaactatatcatcagctctgtttggaagactgtggtagtgtcaatgtggatgttaaaggtcgcagatgctgacctcctgttgtcaggacttgcagttgtccactatgccccatcttccggcagcatagcagtcttaca

SEQ ID NO: 335057 - DNA, 577 bp, Homo sapiens
atccttgaaactaagtttgcttttctgaaaagataaatcacaaacctttagccaaacaaaccaagaaaaaagaagagtcaatcagacatggaagatgagacattacacttaataccacagaaatacaaaaggtcataagacaacattatccacaactatatgcccacaagttagacaatctaaaagaagtagagaaattcctagaaagataaaacctgctaagactgaatcatgaggaaatagaaagtatctttcattaatgcagaattgaggaaaacaaattaggccaggtgccagtggctcacccctgtaatcccaccaccttgggaggctgaggcaggcagatcacttgaggtgaggagttttgagaccaacctggccaacatggcgaaaccgtgtctttactaaaaatacaaaaattagctgggtgtggtggtgcatgcttgtaatcccagctacttgagaggctgaggcacaagaatcactttaaccggggaggtggaggttgcagtgagcctagatcgcaccactgtacttcagcttgggcaacagagggagacttttatctcaaataaat

SEQ ID NO: 335058 - DNA, 508 bp, Homo sapiens
tgcaacctccgcctcctgggttcaggtgattctccttcttcagcctcacgagtagctgggattacaggcgtgcaccgccatacccagctaatttttacatctttaatagagacgggttttcaccatgttggtcaggctggtcttgaactcctgatctcaggtgatccacctgccccagcctcccaaagtgctgggattacaggcatgagccgctgcacccggctccattccttttctctgcgacaaacctgcgtggtgataagtccactcccttgactagtttaattctgaagcttattgatggattcctcaaacagatcttgtggaccaaattattctatttttctgtagagcctggcgatttgagataatctatctgcacagttttgtagtgtttgcttccatcactcaagagtaagacaatatgtcagagttatcttgatggagggataagagagagatagtttggagacagagcagaaaacctttctagtgtacttggtaatga

SEQ ID NO: 335059 - DNA, 712 bp, Homo sapiens
tccagcccgggagacagagtgagactccatctcaaaaaaataaaatgaaattaaataaaataaacggtttaagtttcgacatgggtaaatacccatgaaccatcaccacaattaaggtaatgagcatacccatctctccaagacttctgatgctcttttgtaattttgccctcctacatctttcttcccttccctgagccacatcccctgataatcactgatctactttctctcactgtctagagttttaaataccacagtttgtttattcatgtacctttgtggatggacctttgaatcatttccactttgcggctactacaaataaagttaatgtcaacatttatgtacaagtttttgtggctactacaaatgaagctaatatcaacatttatatacaagtctttgtgtgaacataggggttttttttgtttgtttaacatcatatcactgaaagaggcattgaagaaggttatgctttcatttttcttgggtgacatcttgaagtagaatggctggactatatagttggtttatgcttaactttttaagaaactgccaaattgttttccatacggttttacctttttacagtcctaccaacatgtatgagttctgcttcctcaccaatacttgatatggtcagtccttctaatttagccattccaatacatgtagagatatatcattgttgtttgattttgcatatccc

SEQ ID NO: 335060 - DNA, 270 bp, Homo sapiens
tcagccatgaggctctgaaccctgctgccaactcccagcccagcccctgctcctccaccctcagggggctgtccacttccccacacaggctttccgcatggatttactgagaatccacgttgttctgggtgtgtgaggctgctggggatacatcagacaccgtctccctgctctcctggagccgacagccaataaacaggaactcaagtaaagaaaacagaaaggccaggtgcggtggctcacacctgtaatcccagcactttgggaggc

SEQ ID NO: 335061 - DNA, 300 bp, Homo sapiens
taaaatgtgggcccttctagatgacaattgggctgactgcttcaaaaagtcagtatcacaagtgaaggagaggtgggtaggctgttcttgttaaaagagacaaaggggctgggcatggtggctcacgcctataatcctagaactttgggaggccgaggcgggcagatcacttgaggtcaggagttcaaaaccagcctggccaacatggtttagtagaaaccctgtctctactaaaaatacaaaaaagttagctgggcgtggtggtgcgtacctgtaatcccagctatttgggaggctgag

SEQ ID NO: 335062 - DNA, 607 bp, Homo sapiens
aatgatcctttaattgaaatggagttgtcatttccttgccatgctgataaaatgttgttgctgttgttgtttgttgttgttcttaaatgactctttcagaatttttaactcagtattttgattacataccattttaagaaaataattgtccataaattaaaaatgctagcaaattgatgaattgattttctcatgccaatttggaaatctgaaatatatctaagactggtgaataatatgtaggtctaattgccatttgaataaaagaatctgaggaagagctttgcctttatttttgtttattattcattttagtttagttatttattttagtagaaaaatgtggttgtgtcaacgaagaggaggtacattaaaatgcattattaaagccaatgcttatccatgtaatgaaatgagaatgtagatggcttaatgggttttggagaggattaagataattttaaagaaacttcaaaaaatcagatgctcgaatcatgatgttttttgtttatatttaataaatatgaaaaccatacatgggcatatcaacaatgaggaattcacatatatatcacgaagtctcttgctaatttgtcaacttttaaat

SEQ ID NO: 335063 - DNA, 174 bp, Homo sapiens
gggctcgtgggcagacagcaccctttggaaggaactgagcctgggaagtgggaaccctattccccggctcacaacacctcccacccggggccctcccagggctgcatgaagtttagtcacctggtgacaggctgagttactgtgcggagtcactgtgtgcctccttgctgctgt

SEQ ID NO: 335064 - DNA, 645 bp, Homo sapiens
ccaggtggggagtataggttgttggattcatccatcttgactcaaggaagaagaagccacaggttttacatcttccacggagaagtaattttcctatggatttgtggtcgggacccaagagcctggttgaaaaatgatgtagggagatggccaagcaagagagcacccaaagctggaatttcatccacgaagcctgcaacactagtggggttctgcttgagactccaccagcatggatcctggccaccgccagtgtggcctcctgtgggcactaaggtgcctatgcctttctcactgaagcaaacaggcggtagtgggcagagctctggttccccttgaaattcgctctgtcagccgggtacagtggcttatgcctgtaatcctagcactttgggaggtggaggtgggtggatcaggaggtcaggagatcaagaccattctgactaacatggtgaaaccccgtctatactaaaaatacaaaaaaattgccgggtgtggcggcacgcacctgtaatcccagctatttgggaggctgaggcaggagaatcacttgaacccgggaggtggaggttgcagtcagccgagattgcgccactgcactccagcctgggtgacagagtgaaactccggctcaaaaaaaaagaa

SEQ ID NO: 335065 - DNA, 340 bp, Homo sapiens
cactctccccttcttttcttttagtttccacaacagactcttctgtccccctacccccctcccccaaccaagtgaaatctttatgccactaccaaaaacctataaaagcggccaagcctcttccagctcctttctagtccttaatactgacagtaatgagaggctgccctggggaacccagattctaggaacataatctgaagaaagacagtccggatgctagttctacaaaatcctttggatttatgcttctcatcctcatattttaaaagctcaactaaagcagcttaatttcatttagcagagaattgctgaactaaactggataagagttctactt

SEQ ID NO: 335066 - DNA, 538 bp, Homo sapiens
ttaatacctgtgttcaaacctctcaagagcaggtggcaacagcctagtttccttcctgagatgtggctagaaggtagtattgctgtgctggaactctggaaccaagagatgttgctgccaactcaccctgtagtacaagaatagttgattctggatccaacatggatgtctgtgatcacatgcaccatgccattcactggaactggaggagtttcacatgatttacctgtgggaaagaaaatgttttggagccaggtagagtaatctgaactctcttcagtacgtaaggtctcaacctgcatgtagcttcctgaagaaaacacgcagttctgatagttccacagattttggcaccttgagaaaactcatcagagagcctcaggatcagccacctactaagccccactttcaaaaagaccttccctccagatctatctagatctagatttagatctgtgtagagaccttgcatcccttatcaaaatgtaaaggtcatttatggcattatttactaccaataaagttttcaaaggatttc

SEQ ID NO: 335067 - DNA, 509 bp, Homo sapiens
taacttctttttgtctctgaaattcacttaaatacctttttgaccataattagcaatgctgagtagtgttatatattatagcatatttaagtccaagggaatggtttgcttcttggactcaaatctcttatttatatccttggataaaataggaagtcaagaaaggcaactatcttttctccttttcccggccttctggtgtaaacaaaacccataaacccattcttcccctatctgattatttcatggtaggctttgagtataaaacacgatgaatgaggtatgagtcacccttggccattcagtttggcagacattagggagtacctaaattgtatcaggtactgttctaggatttacagatcaaaacataattaatcttggttcctgcctttgaggagcttatcgtctggtttgattaggctgaaatgtaatttgaatttcaatacaatgtatttcttagggtttttagatcttttgtagtctaacgtgatgagccttaaaattac

SEQ ID NO: 335068 - DNA, 477 bp, Homo sapiens
ggattgctaaataatttttaaaagaagattaaagtttcatgccttgtcaagaggccaattaatgtagcacagctaggcaggtaggaaagaaaaacttcacctgtcacaagataggaatgtgttggttgatactccctgtcttcctttgaaatcataccatcgaaatgaaagttgtccctagttttaataacctcctgacaagaggattccactgtttctctgctatcccatttcaatatttaacaactttctaaaagtctgagcatctcttgcttcagattgtcaatttttctgttattgttaggaaacagagggtcattctcttacgtaatactctccttatgattgtggtcggggaagagaatggtgccccacaggaatcttagacctcctgttccatctccatccttttgatatacaaagggcagcagttctcaaagtgtggtccatggaccagcagcatcagcatctcctggg

SEQ ID NO: 335069 - DNA, 169 bp, Homo sapiens
atttaagttttcttagaaatgctttggctataccacattttgatattagtgcttttgttaccatcaatggttagtagttcttcctttttatgtattttttaaaacccagttatttagtaaaatttaatgtagtttccaagcatatgggatacttttgttacatattgct

SEQ ID NO: 335070 - DNA, 435 bp, Homo sapiens
acggctggcttttaacattaggcacaaataaggggatatcttttactatgatgacaaaactgatttactataaacaagtaatatgaaaagtatttgtttaattaaatagcaaagtcattgatgatcctgttccaaggtgtttctggacagaatttacacaatagaaaacaatatctatctaggaagacaaaatatgtggctacggactcacctcaaatgaaaatagagaaaccagctttatagatctaaaaattttagatctcagggttaatgttttaaaagaatataaagaaactcataattgattaaataataataattcaaagagaataaatgaaacacaagtatctctaggctagaaaatttcatctttgtcgtataaatttatatagctaacagaatgttgtgtgaggagaaaggggaaagtggaatagg

SEQ ID NO: 335071 - DNA, 292 bp, Homo sapiens
ctcttctactgactttccttccagctctgagattcagttttgaagacaaggttgttggggacctcggatagatctgttggccgtggctttcagtaaacactactagagactgaggacatgttctagacttggaatggtatgaagcagtcgaactttttaggatgggccctacccttagggactgcctacgaaactagatctagaagaggaggctgtggacattaggaggtggctgcaattggaaagttccagagagcttactgagggataacggatgtaggacaggaggctg

SEQ ID NO: 335072 - DNA, 488 bp, Homo sapiens
tttttgtattttttagtagagacagggtttcaccatgttggccaggctgttgtcgaactcctgacctcaggtgatccgcctgcctcggcctcccaaagtgctggaattataggcgtgtttgataaggaagtttaagagaggatagattccaagtataaaaataactttcatttctgaataagcgttttgctttttaatggtgtttacttttttttccactgcatctcttttcctaagggatcttttcataactctgagtgtgtgggtttaaatttaaaagggttctaattggcaagatgctttttggtttacagctagaaaatggttctacttattaaagctctaatagttgtcttaggctcatgttcttcagttctttatttctcacacagaagagtttacttgtttgacttgtaatatgaccaggagaaagaagaaacaaaacatagcaataatttatcagaaggcatttatgccctgtatccttg

SEQ ID NO: 335073 - DNA, 164 bp, Homo sapiens
aatacagtctcactgcaaaaaatacagaatcaagggatgaggaaattgagtcctaggaactaaattggcttgttgatatcatgtgactgatcagtagttgtacaactaaagaaagagctcatgtctcctgatatgtcttttcttcatacaatgtcactacatgc

SEQ ID NO: 335074 - DNA, 209 bp, Homo sapiens
aggctgggaggcagttgaggccatcccaaacagccccaacccgctccagagggagggcaggaacgtgggtggggacagtagatggggctcaagaatgcagccagcacatcacagtcaggaggagaggcgaggccatagggtgaaaggtctttttctcagatccaaggggtccagcccctcctcccaggcagatgcacactcagctgctg

SEQ ID NO: 335075 - DNA, 558 bp, Homo sapiens
ggagtctcgctctgtcacccaggctggagtgcagtggcgtgatctcagctcaccgcaacctctgcctcccgggttcaagaaattctctgcctcagcctcccgagtagctatgattacaggcatcccccaccatgcccagctaatttttgtatttttagtagagatggggtttcaccatcttggccaggctggtcttgaactgctggccttgtgaaccacctgccttggtctcccaaagtgctgggattacaggcatgagccaccgcacctggcctcagaaagtttttagaacatttggttggtacaggccagagcacatatggtctgtgtaattagccaactccttagagctgcttggggtttctggactggctgagttactgcttcatatcttttagctctttagccttattaatggttgaattacatattaacttttctcatacagaaaatgttcattctccctgaacatgaagagctaggataatgattttcttaaaatgagcagatagcagatgttgatcttaaagtgttcaaggattgaggccttgtttaaga

SEQ ID NO: 335076 - DNA, 119 bp, Homo sapiens
acgggaaaacagaaaactgggttgcaaatactttatagagtctcactcagtcatcctgccgaaatgcagtggtgtgatcatagctagccttgaactcttgggctcaaggaatcttcctg

SEQ ID NO: 335077 - DNA, 140 bp, Homo sapiens
tgcaattggaaaagcaagctgtctaccatgtaggtgaggagttggtattgctgttcttaaatccacagactgactttcatttcttgttctaacaaagcaagacagattgactttctgtccccagcaagctgcagtcctac

SEQ ID NO: 335078 - DNA, 810 bp, Homo sapiens
cgcgaacttcctcccggcgcggcccgtgccccgccggccgcctgcgaacacctcggcctccgcctcccctcaggttgatgccggcccaggatggatcagacctgtgaactacccagaagaaattgtctgctgcccttttccaatccagtgaatttagatgcccctgaagacaaggacagccctttcggatgatccagattccagtaccagtacattaggaaacatgctagaattacctggaacttcatcatcatctacttcacaggaattgccatttagactggccttgtcatgttgcccaggctggcgtcgggactcctgggctcattcgatcctcctgcatcagctagaactacagtagtttcagattttgaagtgtgtatgtgtatgtgtgatatgtatatattccgtgtgtatagaaatggagagtatcttatttgagttgttgttttcagtaatgctgtcaagtattgttagagggtgataaatgataacatttgtttttatttgagcttatgaagaatttcttgactttctagctaaatgatcagttcacttctcttagcctcaattttattgcgtctaaattccagaagttcttgattgctataagattccttcagctttaaatattaatatttgatattgattttgtttctgcccaaacacattgtttggtcaccgccggtaatgttagcaaagagaattttttttggccaacaaatgtctcataccacattcagtttttataagaaaaacttttatggtatgttgttattctgagttcattaaacattcgctttaccttat

SEQ ID NO: 335079 - DNA, 8260 bp, Homo sapiens
  misc_feature (4287)..(4287): n is a, c, g, or t
  misc_feature (4303)..(4303): n is a, c, g, or t
ctcgctgccttctcccctgaagagagacgcggggggaggggggtgcggcgagcggccccgctctctccccaccgctccgctcgcaccccagtgtaatgagggtcaccccctccccccagctggcccgggagggggcgcggggcacggttgatgccggcccaggatggatcagacctgtgaactacccagaagaaattgtctgctgcccttttccaatccagtgaatttagatgcccctgaagacaaggacagccctttcggtaatggtcaatccaatttttctgagccacttaatgggtgtactatgcagttatcgactgtcagtggaacatcccaaaatgcttatggacaagattctccatcttgttacattccactgcggagactacaggatttggcctccatgatcaatgtagagtatttaaatgggtctgctgatggatcagaatcctttcaagaccctgaaaaaagtgattcaagagctcagacgccaattgtttgcacttccttgagtcctggtggtcctacagcacttgctatgaaacaggaaccctcttgtaataactcccctgaactccaggtaaaagtaacaaagactatcaagaatggctttctgcactttgagaattttacttgtgtggacgatgcagatgtagattctgaaatggacccagaacagccagtcacagaggatgagagtatagaggagatctttgaggaaactcagaccaatgccacctgcaattatgagactaaatcagagaatggtgtaaaagtggccatgggaagtgaacaagacagcacaccagagagtagacacggtgcagtcaaatcgccattcttgccattagctcctcagactgaaacacagaaaaataagcaaagaaatgaagtggacggcagcaatgaaaaagcagcccttctcccagcccccttttcactaggagacacaaacattacaatagaagagcaattaaactcaataaatttatcttttcaggatgatccagattccagtaccagtacattaggaaacatgctagaattacctggaacttcatcatcatctacttcacaggaattgccatttgttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaagtgctatgaagctggtcacctggagaatggcataactgaatcttgtgccacatcttattcaaaagattttggtggaggcactaccaagatatttgacaagccaaggaagcgaaaacgacagaggcatgctgnagccaagatgcagtgnaaaaaagtgaaaaatgatgactcgtcaaaagagattccaggctcagagggagaactaatgcctcacaggacggccacaagccccaaggagactgttgaggaaggtgtagaacacgatcccgggatgcctgcctctaaaaaaatgcagggtgaacgcggtggaggagctgcactcaaggagaatgtctgtcagaattgtgaaaaattgggtgagctgctgttatgtgaggctcagtgctgtggggctttccacctggagtgccttggattgactgagatgccaagaggaaaatttatctgcaatgaatgtcgcacaggaatccatacctgttttgtatgtaagcagagtggggaagatgttaaaaggtgccttctacccttgtgtggaaagttttaccatgaagagtgtgtccagaagtacccacccactgttatgcagaacaagggcttccggtgctccctccacatctgtataacctgtcatgctgctaatccagccaatgtttctgcatctaaaggtcggttgatgcgctgtgtccgctgtcctgtggcataccacgccaatgacttttgcctggctgctgggtcaaagatccttgcatctaatagtatcatctgccctaatcactttacccctaggcggggctgccgaaatcatgagcatgttaatgttagctggtgctttgtgtgctcagaaggaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtggtggccagctgagatctgccatcctcgagctgttccttccaacattgataagatgagacatgatgtgggagagttcccagtcctcttttttggatctaatgactatttgtggactcaccaggcccgagtcttcccttacatggagggtgacgtgagcagcaaggataagatgggcaaaggagtggatgggacatataaaaaagctcttcaggaagctgcagcaaggtttgaggaattaaaggcccaaaaagagctaagacagctgcaggaagaccgaaagaatgacaagaagccacccccttataaacatataaaggtaaaccgtcctattggcagggtacagatcttcactgcagacttatctgaaataccccgttgcaactgtaaagctactgatgagaacccctgtgggatagactctgaatgcatcaaccgcatgctgctctatgagtgccaccccacagtgtgtcctgccggagggcgctgtcaaaaccagtgcttttccaagcgccaatatccagaggttgaaattttccgcacattacagcggggttggggtctacggacccaagaggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggcttcttgggtgtaaggccaaagaatcaacccattgccacggaagaaaagtcaaagaaattcaagaagaagcaacagggaaagcgcaggacccagggtgaaatcacaaaggagcgagaagatgagtgttttagttgtggggatgctggccagctcgtctcctgcaagaaaccaggctgcccaaaagtttaccacgcagactgtctcaatctgaccaagcgaccagcagggaaatgggaatgtccgtggcatcagtgtgacatctgcgggaaggaagcagcctccttctgtgagatgtgccccagctccttttgtaagcagcatcgagaagggatgcttttcatttccaaactggatgggcgtctgtcttgtactgagcatgacccctgtgggcccaatcctctggaacctggggagatccgtgagtatgtgcctcccccagtaccgctgcctccagggccaagcactcacctggcagagcaatcaacaggaatggctgctcaggcacccaaaatgtcagataaacctcctgctgacaccaaccagatgctgtcgctctccaaaaaagctctggcagggacttgtcagaggccactgctacctgaaagacctcttgagagaactgactccaggccccagcctttagataaggtcagagacctcgctgggtcaggggcccaatcccaatccttggtttccagccagaggccactggacaggccaccagcagtggcaggaccaagaccccagctaagcgacaaaccctctccagtgaccagcccaagctcctcaccctcagtcaggtcccaaccactggaatcacctctggggacggctgacccaaggctggataaatccataggtgctgccagcccaaggccccagtcactggagaaaacctcagttcccactggcctgagacttccgccgccagacagactgctcattactagcagtcccaaaccccagacttcagacaggcctactgacaaaccccatgcctctttgtcccagagactcccacctcctgagaaagtactatcagctgtggtccagacccttgtagctaaagaaaaagcactgaggcctgtggaccagaatactcagtcaaaaaatagagctgctttggtgatggatctcatagacctaactcctcgccagaaggagcgggcagcttcacctcatcaggtcacaccacaggctgatgagaagatgccagtgttggagtcaagttcatggcctgccagcaaaggtctggggcatatgccgagagctgttgagaaaggctgtgtgtcagatcctcttcagacatctgggaaagcagcagccccttcagaggacccctggcaagctgttaaatcactcacccaagccagactttcttctcagccttctgccaaagcctttttatatgagccaaccactcaggcctcaggaagagcttctgcaggggctgaacagacccaggggttttttaccaaatccccggccttggtggaaaacaagggcaaaaccaaatgggtagggaggccaacaaattacttgcatttggccgccaagagttggcaatcttttaggtctctcgggaaggccccaccctcctcccccaatgaagaaaagaagttggtaaccacagagcaaagtccctgggccctgggaaaagcctcatcacgggcagggctctggcccatagtggctggacagacactggcacagtcttgctggtctgctgggagcacacagacattggcacagacttgctggtctcttggaagagggcaagaccccaaaccagagcaaaatacacttccagctcttaaccaggctccttccagtcacaagtgtgcagaatcagaacagaagtagtaccaatcaatgtcacatgaacaaacaagctgcccccagggtaccatttggggaggggaaatcttttctttctttcccccttaaaaaaaaacacatctgccccgaacactttcccactgttattctttcctcatatcccaacactcagaactcttgtgacattagccagtgggggcttatggttgtgtgaaccatgtatgaaaatccagtgggccccaaccaaggagacagacagacttgggtctctttcccccaacttttccacatggtcatcgtgaaataaaaagtccactctggaaaaaaaaa

SEQ ID NO: 335080 - DNA, 4684 bp, Homo sapiens
ctcgctgccttctcccctgaagagagacgcggggggaggggggtgcggcgagcggccccgctctctccccaccgctccgctcgcaccccagtgtaatgagggtcaccccctccccccagctggcccgggagggggcgcggggcacggttgatgccggcccaggatggatcagacctgtgaactacccagaagaaattgtctgctgcccttttccaatccagtgaatttagatgcccctgaagacaaggacagccctttcggtaatggtcaatccaatttttctgagccacttaatgggtgtactatgcagttatcgactgtcagtggaacatcccaaaatgcttatggacaagattctccatcttgttacattccactgcggagactacaggatttggcctccatgatcaatgtagagtatttaaatgggtctgctgatggatcagaatcctttcaagaccctgaaaaaagtgattcaagagctcagacgccaattgtttgcacttccttgagtcctggtggtcctacagcacttgctatgaaacaggaaccctcttgtaataactcccctgaactccaggtaaaagtaacaaagactatcaagaatggctttctgcactttgagaattttacttgtgtggacgatgcagatgtagattctgaaatggacccagaacagccagtcacagaggatgagagtatagaggagatctttgaggaaactcagaccaatgccacctgcaattatgagactaaatcagagaatggtgtaaaagtggccatgggaagtgaacaagacagcacaccagagagtagacacggtgcagtcaaatcgccattcttgccattagctcctcagactgaaacacagaaaaataagcaaagaaatgaagtggacggcagcaatgaaaaagcagcccttctcccagcccccttttcactaggagacacaaacattacaatagaagagcaattaaactcaataaatttatcttttcaggatgatccagattccagtaccagtacattaggaaacatgctagaattacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccaggtggagtcttgctctgtcacccaggctggagtgcagtggcacgatctaggctcactgcaacctccgcctcccaggttcaagtgattctcctgtctcaccctcctgagtagctgcaactacagctgtgcggtcagagaagaaacgccttaggaagccaagcaagtggcttttggaatatacagaagaatatgatcagatatttgctcctaagaaaaaacaaaagaaggtacaggagcaggtgcacaaggaaattatgaaagtaaacgtcaaagaaaaccaactaagaaacttcttgaatccaatgatttagaccctggatttatgcccaagaagggggaccttggcctttctaaaaaggtatgttatttttgtaagttctaaaagaaataaactcaggaaatgagaaattttaaaaatgacattttgagtagcagttataacattgatgtacatacatatagaaattagtgtgtgtgtcagcagtcatacatgatctgagatttcctacatgaaaggctgttttgcagttgtgtgaccatgtatgtgtataaactggtttcaggtttcctttccaagtgaaaaaaatttttaaatgctttgaagattaagtttgtgtttgttataatttcttttctgggttcaaatcctcttacctgttttctactaaactactatctcaaatatcactagtctactctcctattgccgtgtcgtcgtagcccttt

SEQ ID NO: 335081 - DNA, 4093 bp, Homo sapiens
ctcgctgccttctcccctgaagagagacgcggggggaggggggtgcggcgagcggccccgctctctccccaccgctccgctcgcaccccagtgtaatgagggtcaccccctccccccagctggcccgggagggggcgcggggcacggttgatgccggcccaggatggatcagacctgtgaactacccagaagaaattgtctgctgcccttttccaatccagtgaatttagatgcccctgaagacaaggacagccctttcggatgatccagattccagtaccagtacattaggaaacatgctagaattacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaaggtatgttatttttgtaagttctaaaagaaataaactcaggaaatgagaaattttaaaaatgacattttgagtagcagttataacattgatgtacatacatatagaaattagtgtgtgtgtcagcagtcatacatgatctgagatttcctacatgaaaggctgttttgcagttgtgtgaccatgtatgtgtataaactggtttcaggtttcctttccaagtgaaaaaaatttttaaatgctttgaagattaagtttgtgtttgttataatttcttttctgggttcaaatcctcttacctgttttctactaaactactatctcaaatatcactagtctactctcctattgccgtgtcgtcgtagcccttt

SEQ ID NO: 335082 - DNA, 4970 bp, Homo sapiens
  misc_feature (4596)..(4596): n is a, c, g, or t
  misc_feature (4612)..(4612): n is a, c, g, or t
ctcgctgccttctcccctgaagagagacgcggggggaggggggtgcggcgagcggccccgctctctccccaccgctccgctcgcaccccagtgtaatgagggtcaccccctccccccagctggcccgggagggggcgcggggcacggttgatgccggcccaggatggatcagacctgtgaactacccagaagaaattgtctgctgcccttttccaatccagtgaatttagatgcccctgaagacaaggacagccctttcggtaatggtcaatccaatttttctgagccacttaatgggtgtactatgcagttatcgactgtcagtggaacatcccaaaatgcttatggacaagattctccatcttgttacattccactgcggagactacaggatttggcctccatgatcaatgtagagtatttaaatgggtctgctgatggatcagaatcctttcaagaccctgaaaaaagtgattcaagagctcagacgccaattgtttgcacttccttgagtcctggtggtcctacagcacttgctatgaaacaggaaccctcttgtaataactcccctgaactccaggtaaaagtaacaaagactatcaagaatggctttctgcactttgagaattttacttgtgtggacgatgcagatgtagattctgaaatggacccagaacagccagtcacagaggatgagagtatagaggagatctttgaggaaactcagaccaatgccacctgcaattatgagactaaatcagagaatggtgtaaaagtggccatgggaagtgaacaagacagcacaccagagagtagacacggtgcagtcaaatcgccattcttgccattagctcctcagactgaaacacagaaaaataagcaaagaaatgaagtggacggcagcaatgaaaaagcagcccttctcccagcccccttttcactaggagacacaaacattacaatagaagagcaattaaactcaataaatttatcttttcaggatgatccagattccagtaccagtacattaggaaacatgctagaattacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaagtgctatgaagctggtcacctggagaatggcataactgaatcttgtgccacatcttattcaaaagattttggtggaggcactaccaagatatttgacaagccaaggaagcgaaaacgacagaggcatgctgnagccaagatgcagtgnaaaaaagtgaaaaatgatgactcgtcaaaagagattccaggctcagagggagaactaatgcctcacaggacggccacaagccccaaggagactgttgaggaaggtgtagaacacgatcccgggatgcctgcctctaaaaaaatgcagggtgaacgcggtggaggagctgcactcaaggagaatgtctgtcagaattgtgaaaaattgggtgagctgctgttatgtgaggctcagtgctgtggggctttcctattgctgctggtgcagctgtaaaaaagaaaaaaccaaaaattttgggatgacatgaaaggccataatgtcaggaaagagtagagaggactgaataatccagatggca

SEQ ID NO: 335083 - DNA, 3683 bp, Homo sapiens
tcagctcactgcaacccccgcctcctgagttcaagcgattctcatgcctcagcctctcaagtagcttggattacagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaaggtatgttatttttgtaagttctaaaagaaataaactcaggaaatgagaaattttaaaaatgacattttgagtagcagttataacattgatgtacatacatatagaaattagtgtgtgtgtcagcagtcatacatgatctgagatttcctacatgaaaggctgttttgcagttgtgtgaccatgtatgtgtataaactggtttcaggtttcctttccaagtgaaaaaaatttttaaatgctttgaagattaagtttgtgtttgttataatttcttttctgggttcaaatcctcttacctgttttctactaaactactatctcaaatatcactagtctactctcctattgccgtgtcgtcgtagcccttt

SEQ ID NO: 335084 - DNA, 1623 bp, Homo sapiens
ctcgctgccttctcccctgaagagagacgcggggggaggggggtgcggcgagcggccccgctctctccccaccgctccgctcgcaccccagtgtaatgagggtcaccccctccccccagctggcccgggagggggcgcggggcacggttgatgccggcccaggatggatcagacctgtgaactacccagaagaaattgtctgctgcccttttccaatccagtgaatttagatgcccctgaagacaaggacagccctttcggtaatggtcaatccaatttttctgagccacttaatgggtgtactatgcagttatcgactgtcagtggaacatcccaaaatgcttatggacaagattctccatcttgttacattccactgcggagactacaggatttggcctccatgatcaatgtagagtatttaaatgggtctgctgatggatcagaatcctttcaagaccctgaaaaaagtgattcaagagctcagacgccaattgtttgcacttccttgagtcctggtggtcctacagcacttgctatgaaacaggaaccctcttgtaataactcccctgaactccaggtaaaagtaacaaagactatcaagaatggctttctgcactttgagaattttacttgtgtggacgatgcagatgtagattctgaaatggacccagaacagccagtcacagaggatgagagtatagaggagatctttgaggaaactcagaccaatgccacctgcaattatgagactaaatcagagaatggtgtaaaagtggccatgggaagtgaacaagacagcacaccagagagtagacacggtgcagtcaaatcgccattcttgccattagctcctcagactgaaacacagaaaaataagcaaagaaatgaagtggacggcagcaatgaaaaagcagcccttctcccagcccccttttcactaggagacacaaacattacaatagaagagcaattaaactcaataaatttatcttttcaggatgatccagattccagtaccagtacattaggaaacatgctagaattacctggaacttcatcatcatctacttcacaggaattgccatttagactggccttgtcatgttgcccaggctggcgtcgggactcctgggctcattcgatcctcctgcatcagctagaactacagtagtttcagattttgaagtgtgtatgtgtatgtgtgatatgtatatattccgtgtgtatagaaatggagagtatcttatttgagttgttgttttcagtaatgctgtcaagtattgttagagggtgataaatgataacatttgtttttatttgagcttatgaagaatttcttgactttctagctaaatgatcagttcacttctcttagcctcaattttattgcgtctaaattccagaagttcttgattgctataagattccttcagctttaaatattaatatttgatattgattttgtttctgcccaaacacattgtttggtcaccgccggtaatgttagcaaagagaattttttttggccaacaaatgtctcataccacattcagtttttataagaaaaacttttatggtatgttgttattctgagttcattaaacattcgctttaccttat

SEQ ID NO: 335085 - DNA, 931 bp, Homo sapiens
ctcgctgccttctcccctgaagagagacgcggggggaggggggtgcggcgagcggccccgctctctccccaccgctccgctcgcaccccagtgtaatgagggtcaccccctccccccagctggcccgggagggggcgcggggcacggttgatgccggcccaggatggatcagacctgtgaactacccagaagaaattgtctgctgcccttttccaatccagtgaatttagatgcccctgaagacaaggacagccctttcggtaatggtcaatccaatttttctgagccacttaatgggtgtactatgcagttatcgactgtcagtggaacatcccaaaatgcttatggacaagattctccatcttgttacattccactgcggagactacaggatttggcctccatgatcaatgtagagtatttaaatgggtctgctgatggatcagaatcctttcaagaccctgaaaaaagtgattcaagagctcagacgccaattgtttgcacttccttgagtcctggtggtcctacagcacttgctatgaaacaggaaccctcttgtaataactcccctgaactccaggtaaaagtaacaaagactatcaagaatggctttctgcactttgagaattttacttgtgtggacgatgcagatgtagattctgaaatggacccagaacagccagtcacagaggatgagagtatagaggagatctttgaggaaactcagaccaatgccacctgcaattatgagactaaatcagagaatggtgtaaaagtggccatgggaagtgaacaagacagcacaccagagagtagacacggtgcagtcaaatcgccattcttgccattagctcctcagactgaaacacagtcatagtagcagatgtttaatgtctgtcggcagccgggcagtgaaagcgtattcatcgct

SEQ ID NO: 335086 - DNA, 730 bp, Homo sapiens
  misc_feature (356)..(356): n is a, c, g, or t
  misc_feature (372)..(372): n is a, c, g, or t
ggtgtgagccatcatgccctgtctgttggagcattttaaaatctgattcctttccccctgaagtttccgttcaaccctttactgtggtcaggttgatttctttaattgctaaaacaagtcaaaattcaatatccatggcagctgacaattcagactttggcatataaagtaaagggtttattttttcattcctctgtaaatggtgttgttttcacttatttatagtgctatgaagctggtcacctggagaatggcataactgaatcttgtgccacatcttattcaaaagattttggtggaggcactaccaagatatttgacaagccaaggaagcgaaaacgacagaggcatgctgnagccaagatgcagtgnaaaaaagtgaaaaatgatgactcgtcaaaagagattccaggctcagagggagaactaatgcctcacaggacggccacaagccccaaggagactgttgaggaaggtgtagaacacgatcccgggatgcctgcctctaaaaaaatgcagggtgaacgcggtggaggagctgcactcaaggagaatgtctgtcagaattgtgaaaaattgggtgagctgctgttatgtgaggctcagtgctgtggggctttcctattgctgctggtgcagctgtaaaaaagaaaaaaccaaaaattttgggatgacatgaaaggccataatgtcaggaaagagtagagaggactgaataatccagatggca

SEQ ID NO: 335087 - DNA, 4833 bp, Homo sapiens
ctcgctgccttctcccctgaagagagacgcggggggaggggggtgcggcgagcggccccgctctctccccaccgctccgctcgcaccccagtgtaatgagggtcaccccctccccccagctggcccgggagggggcgcggggcacggttgatgccggcccaggatggatcagacctgtgaactacccagaagaaattgtctgctgcccttttccaatccagtgaatttagatgcccctgaagacaaggacagccctttcggtaatggtcaatccaatttttctgagccacttaatgggtgtactatgcagttatcgactgtcagtggaacatcccaaaatgcttatggacaagattctccatcttgttacattccactgcggagactacaggatttggcctccatgatcaatgtagagtatttaaatgggtctgctgatggatcagaatcctttcaagaccctgaaaaaagtgattcaagagctcagacgccaattgtttgcacttccttgagtcctggtggtcctacagcacttgctatgaaacaggaaccctcttgtaataactcccctgaactccaggtaaaagtaacaaagactatcaagaatggctttctgcactttgagaattttacttgtgtggacgatgcagatgtagattctgaaatggacccagaacagccagtcacagaggatgagagtatagaggagatctttgaggaaactcagaccaatgccacctgcaattatgagactaaatcagagaatggtgtaaaagtggccatgggaagtgaacaagacagcacaccagagagtagacacggtgcagtcaaatcgccattcttgccattagctcctcagactgaaacacagaaaaataagcaaagaaatgaagtggacggcagcaatgaaaaagcagcccttctcccagcccccttttcactaggagacacaaacattacaatagaagagcaattaaactcaataaatttatcttttcaggatgatccagattccagtaccagtacattaggaaacatgctagaattacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaaggtatgttatttttgtaagttctaaaagaaataaactcaggaaatgagaaattttaaaaatgacattttgagtagcagttataacattgatgtacatacatatagaaattagtgtgtgtgtcagcagtcatacatgatctgagatttcctacatgaaaggctgttttgcagttgtgtgaccatgtatgtgtataaactggtttcaggtttcctttccaagtgaaaaaaatttttaaatgctttgaagattaagtttgtgtttgttataatttcttttctgggttcaaatcctcttacctgttttctactaaactactatctcaaatatcactagtctactctcctattgccgtgtcgtcgtagcccttt

SEQ ID NO: 335088 - DNA, 4575 bp, Homo sapiens
ctcgctgccttctcccctgaagagagacgcggggggaggggggtgcggcgagcggccccgctctctccccaccgctccgctcgcaccccagtgtaatgagggtcaccccctccccccagctggcccgggagggggcgcggggcacggttgatgccggcccaggatggatcagacctgtgaactacccagaagaaattgtctgctgcccttttccaatccagtgaatttagatgcccctgaagacaaggacagccctttcggtaatggtcaatccaatttttctgagccacttaatgggtgtactatgcagttatcgactgtcagtggaacatcccaaaatgcttatggacaagattctccatcttgttacattccactgcggagactacaggatttggcctccatgatcaatgtagagtatttaaatgggtctgctgatggatcagaatcctttcaagaccctgaaaaaagtgattcaagagctcagacgccaattgtttgcacttccttgagtcctggtggtcctacagcacttgctatgaaacaggaaccctcttgtaataactcccctgaactccaggtaaaagtaacaaagactatcaagaatggctttctgcactttgagaattttacttgtgtggacgatgcagatgtagattctgaaatggacccagaacagccagtcacagaggatgagagtatagaggagatctttgaggaaactcagaccaatgccacctgcaattatgagactaaatcagagaatggtgtaaaagtggccatgggaagtgaacaagacagcacaccagagagtagacacggtgcagtcaaatcgccattcttgccattagctcctcagactgaaacacagaaaaataagcaaagaaatgaagtggacggcagcaatgaaaaagcagcccttctcccagcccccttttcactaggagacacaaacattacaatagaagagcaattaaactcaataaatttatcttttcaggatgatccagattccagtaccagtacattaggaaacatgctagaattacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaagtgctatgaagctggtcacctggagaatggcataactgaatcttgtgccacatcttattcaaaagattttggtggaggtgagtatttttgagatttaaaaaacgtaatgca

SEQ ID NO: 335089 - DNA, 3557 bp, Homo sapiens
agcaagactctgtctcaaaaaaaaaaaaaaaaggaataaaaaaaaaagcttctgatttcatctcccttttcccccacccatttctttgataagtgataattctttttctcctttaaatttaaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaaggtatgttatttttgtaagttctaaaagaaataaactcaggaaatgagaaattttaaaaatgacattttgagtagcagttataacattgatgtacatacatatagaaattagtgtgtgtgtcagcagtcatacatgatctgagatttcctacatgaaaggctgttttgcagttgtgtgaccatgtatgtgtataaactggtttcaggtttcctttccaagtgaaaaaaatttttaaatgctttgaagattaagtttgtgtttgttataatttcttttctgggttcaaatcctcttacctgttttctactaaactactatctcaaatatcactagtctactctcctattgccgtgtcgtcgtagcccttt

SEQ ID NO: 335090 - DNA, 1678 bp, Homo sapiens
ctcgctgccttctcccctgaagagagacgcggggggaggggggtgcggcgagcggccccgctctctccccaccgctccgctcgcaccccagtgtaatgagggtcaccccctccccccagctggcccgggagggggcgcggggcacggttgatgccggcccaggatggatcagacctgtgaactacccagaagaaattgtctgctgcccttttccaatccagtgaatttagatgcccctgaagacaaggacagccctttcggtaatggtcaatccaatttttctgagccacttaatgggtgtactatgcagttatcgactgtcagtggaacatcccaaaatgcttatggacaagattctccatcttgttacattccactgcggagactacaggatttggcctccatgatcaatgtagagtatttaaatgggtctgctgatggatcagaatcctttcaagaccctgaaaaaagtgattcaagagctcagacgccaattgtttgcacttccttgagtcctggtggtcctacagcacttgctatgaaacaggaaccctcttgtaataactcccctgaactccaggtaaaagtaacaaagactatcaagaatggctttctgcactttgagaattttacttgtgtggacgatgcagatgtagattctgaaatggacccagaacagccagtcacagaggatgagagtatagaggagatctttgaggaaactcagaccaatgccacctgcaattatgagactaaatcagagaatggtgtaaaagtggccatgggaagtgaacaagacagcacaccagagagtagacacggtgcagtcaaatcgccattcttgccattagctcctcagactgaaacacagaaaaataagcaaagaaatgaagtggacggcagcaatgaaaaagcagcccttctcccagcccccttttcactaggagacacaaacattacaatagaagagcaattaaactcaataaatttatcttttcaggatgatccagattccagtaccagtacattaggaaacatgctagaattacctggaacttcatcatcatctacttcacaggaattgccatttgtaagcagtttttggtacaacttaaatatatacatatatgtatatatacaggccacttaaagggaaacttgtaacaaatttgtttttggttgcttatcagttcacagctgaaatcctattgctaatcataagctttgggcaaaattttactttgatttttaaatttatctctgttgtatgaatttggttgttttaagctttttccaaataactcttcattgagagtaggctaatgcttttaaaggcatttgattgagttcaggtttaatttctcaagttggaggtatacatatatgattaaaaaaaaaaaaaaaagatgggttttggcctgccagcaccatgagtgcaggtgaaccaatttagtacttggagtcctgttgctatatgtggcagattatttttttacttgatgacttgactcttacttcaggttgaagggcattttgaacacagattaaagtggctaagatgaagttttcttggacattgtcaaaatctaaattaggctagtttttctgaactacctgttttgaaggtatagcatcctgtgcttttgataactgccaccattagctctttttttttttt

SEQ ID NO: 335091 - DNA, 3792 bp, Homo sapiens
gcaggatagaaaatgggcaaaagcctcggaaaccacttggaaaaggtctggacaatgaggtgaaaatattttcttcagggttcccaaggcacaatttgttccaagtggctaatgagaaatatggaagctgaattttttccagagcagagtgcagaggcataacagaagggtgggccctggcagccatctgggtctcttccttcctaaccatggtggcaggtgcatccttctttgacactgactttcagcagagcttacttggttcatgaggtcttcacatggagactaccagcaagaggtgactctctgctgcataactgtaaaggatggccctttgctaggtgttacagttaaaagctaagaaaaggggcagtgcatttaggacccaaacatatgcctatgaatatcaaaagctcctcctgaaattgctgtgagttttccataaaagaatatcctgtcttcacccaaggcttgacagcccacagagtggtctcatttgaaattacaggaaattagagcttttgcttgcagttctgccttcctggcctgtgtttaaatgctgtcacttgtttatgccaagttcaaggctgattcaatggttggtcccctcacccagaaaaccctgaaggggaggatacagctctgaaggggggcagcagtactaaaaacccaagatgccagtggtatagtgggcacaagggatggcgaccatgaggatgccaggcatcatcaccaatatctatcctagagccagtataaggccagatgcctacttcccacagcctccccgggttccaaagtcatgtcattgttttcagtggaaacatatcgttgttgcatatcttcttaaatccatcttccttgtaagggctttagaactaaaacttacttatattgtttttccttaacagagggagaaaaatagtggattattatttctaaaataaaaggatgttctgctttctaaatatcccatcaaaatcttcagttttgcacttttttgatggaaaattcatcttatcttcctatgactttggttttagcctttctgaatttgttaccccttctggatggcttatttgatatactggaatagttaacaagctatacttcagcatatgcactatattctaacaaattttttttaataaaatcaagacatcagcaagaatgacatttacgtgacctcataatgtgggattatggccttctgttgctattccagtttgatatggaagcatctatatcctctattgccgttagatgttgttgcttttcagaaaagtaacgaaaaggctcattttaaagaatccaagaaacgatgtcatccaaatattgacagtttctacatttcatgccatctttataactcaattgaaagttgccgtcattcttgtgaagtatttgacaagtgcaatctgctagaagctcgtttttcttgtgactcccaaatgttagtgctacttagcctcagtaatgagttacagttgaaaaaaacatgagggaaacagagggacagagattttctaatgaacaatgatggaagagacctaatgtccttgctagaaacagccaggatggaaattatccagccctggcattctccttatcatcaatgacagtcattttattcatttatttcaaatgtgggtgggctagaagtggaaggagggaattctctctgcctaaaaattctagaagaatgaaagtaatctttgtatccaggaaactaagagaatgaggaataaatatcttcagcccgactcctgaatttgtttattcttccatctataattagattgtgttttcatttttgctttgtcatgctttttggttgttatttggctatacagttttatgctttaaaacaaatgataaagttaatttccaattcaatagtgaaatattaacaatctaactatagccagatcaaagacacctgaacacagaaaacctttatttgctggtgctgccattgcacaggctgtacaatgaaatagatttgaaaagctgattgattttcccgcacataaattctggatgtcaatttccaaccaaactccaatccagctatgtggcatgaagagttacaggagggagggaggaaaatagccctatgttagtcatgtttgcatacagaggatcaaagtaggccttcaccataatagttctaattaaaatggtcctcgctgtaggagagacaaaggggcttttcctctagctggtaactattcagatgatggacaagtcttctttcataaaagattacaaagaaggcatccgaatcactgtctgtgatactgggtcacatattaatcactgcagctaattgtaaatctttctatgaaacactgaaaagcctctttgtgaattaatacagttctgcttgatgcacttgatttgaaaagacatttctctgtatgtggcgcatgtcggctttgctttgaaaaataacaaagttagcagaatatgttcaatatattttcttggggaatagggtttttattacatgattcattaaggatttgccttaccctgacatttgtgatataaaggaaaatcagaaaaaaagtaattttcttgatcaagatatgtttttacttaatgcaaataaatgtagtctgttgcttgcaaggaaaaaaaaatggcttctgatatctggtataaactgctaaataggataatacgtgcctcttttgttaaaccggcatttaaatgctggactgcttctaaatctgtttgtttcttttcatctgtgccatacactaaaaaacaactgttgccttcatactatatttgttagagcagaatacaaataaaatttgagaggataatgtgaaaaaaaaaaaaaaaaaaaaaaaaaaaaaaaaaaaaaaaaaaaaaaaaaaaaaaaaaaaaaaaaaaaagagaggggggcgcgcgcgcacaaaaactatctccccgggggggcgccaaaatacacgcgccccccgattttttttgcaaacaaggggggccccaataagaggggagagcgatatatatatataaaaaaagagagagagggggcgggggatcaaaaaagagagcaagggggaaaaacgtcgtaacaggggacattgggggaaaagagaaaccacaacggaggggggggcgcggacaatactgcggcgacacaacacacaaacagaaaatactaaaaagccccacaagggagaaaaaaaaaaagctaaaagacgagaacaacacggtgaacacacaaacgcaacaaatcaactcgcaaggaaacaaactttgcagacaacggggaataaacaagcacagacaggcaaatctttcacacaggggggcgtccgcacgtgcaaccaacacaacgacaccaggacacactcagatgaaacaaacaaagacagaaagaaagacaagaaaaaaacaaaagaacaaaaaaaaaccacacaacaaagagcacaaaagaccaaaacacacaaacaagaagacaacaatcaaaaaacagaaagaaaaaggagacaaacaaaaagagtaaaaaagaaaaaaaaacacaaaaagaacaaagaaaaaaaaaaagaagaaacaaaaaaaagaaaaaagacaaaaaaaaaaacacacagacacataaaataaaaaaaaacgaaaaacaaaaaacgcagaagagaaagcgcaagaaagaacaaaaatgagcaagcgacaacaaacaatatcaaagcacaagacacacaaaacaggaagaaacaacaaacagcaagtaaccacgaatgcagcaaacagaaaaaacagcaaaaaaacaacaaagaa

SEQ ID NO: 335092 - DNA, 714 bp, Homo sapiens
agcctctggagagcgctgaaaacagacgtgtcacccccatggtggaatactacacagcagggggaatgaacgttacagcttctgtccttgtctgcaagactgtagtggaaaaaaacaaagttcagaacaacacgtttaagaggctacctgtctagctttggttagagaccttacaaagaggtgaaaaaaaaggggggactacctcatacgaggagcaaacgaaatctgtatttgggtttgcaaaacaaacacctgggcaagtacattcaaaactaattagatgaggccatctccaggggtgaagggagcggtgggacagaagacagtggaatttctcagtacaggggctcttcattttgttctgatttgtgagctaggttaatgtattcattgttttttccattaaatttaagaaattcggccaggtgcggtggctcacacctgtaatcccagcacttcgggaggccaaggtgggtggatcatgaggtcaagggatcaagaccttcctggtcaacatggtgaaaccccgtctctactaaatatacaaaaattagtggggcgtggtggtgcgcacctgtaatcccagctactcaggaggctgaggcaggaagatcgcttgaacccgggaggaggaggttgtagtgagccgagatcgtgccactgtactccagacagagcgagactctgtctcaaaaaagaaaaaaaaaaaaaaat

SEQ ID NO: 335093 - DNA, 505 bp, Homo sapiens
gcagacagagaagagggtgagggacaggccagcggggaatgcatctgtgcaaggagtgagaggaagcagaagggctgagatggagccatccagaggaggagctaacaggggagctggaagccaccctgtgggaacagggaagagggaactccaggagaagtcttggtgaggggagcaatcgctgccaggtgaggtgtaaaatcatccatctcttttgaaaagctacaggtgccatgccttagaaatgttcagagcagcagttcccctatttgaaatctctcttaagaagagccggtctggcattctctgctctaccacctctagaggctcccattgctttcagactcactgaccagccacgaggtcctgcctctctccctgccttcctgctcttacctggctcatgctctgccagactccttgccattccctcaatgccttgcttgcacgttgccactgcgtgccttggcacacgaactccacctgtctgagcctctgtctgtca

SEQ ID NO: 335094 - DNA, 581 bp, Homo sapiens
ttcctatgttgagacccctgtctactagaagcaacagtgaatatagggagagaggatttgaaagctgatcatggctgatcccagggaaagaaaggtctccccttgcccctccccatacacacactgaggactcagaaacgttgtcccaccttctgcagccaggagtccccaccacctcccacactccagcctgggcaacacatcttctgttagcccgcttcatcatgaagcataaattaaacagaacaccagagggaaacttgccaccataggactgacgctcaaagccctttctgagttggatggcagcttagttggattccttatcagcctctggctctgaggacccagtgttccaggttaatgtgaatgtttggcggcaacagctcacaccaaccctgcccttttggttcagcgagagtcagagacaacagaaactgtctcagaccccaggacacaacttctagaattggattggactatctttgctgtccttttaaacttatacttgaagactatttaaactgctttttaaaatgaaatgaggctgggcgcagtggctcatgcctgtaatcccagca

SEQ ID NO: 335095 - DNA, 431 bp, Homo sapiens
taaaatagggaacacttaaagcttatagatgacatgttttttaaaaggtatatttatgaaagcacaggcatccttggtatacgcaggagattgataccaggacccttgtgtatacccaaatctgtgcatacttaagtcctacagtcatccctgtggaacctgcctgtataaaaagtcagccctccccgtgtatgtaggtgtcgcatcccgggaatactgtattttcaatccatgtttggtttaaaaaaatctgcgtataagcagacccacacagttcaaactcatgctgttcaagggtcaacagtatttactttgcatacttatccaaagatacctttaagactttttgagtctgaaaatgaaatttactttattttttcccttaaagtcaactgtcctatcctaccctagccatactttggagtccagta

SEQ ID NO: 335096 - DNA, 254 bp, Homo sapiens
ggcactttgattttaggtctctcttcattctttcccaactcacctccttctgtgttactgttcctcctctgccccaatctcaatttctgtagcccataccacggtacctcatcccccacaaaaatgaaagtaatacttttatcatgttcgtaggttgatatttgggaagatatatacaattttaaattcactttaaatcttcaagttcttttcctatttatcccccacccaagcattgtgttaaaccctgtgaa

SEQ ID NO: 335097 - DNA, 526 bp, Homo sapiens
tggtctcttgcaactgagcctcatttaaatgtgcattgtgttgaatggagcctcatttaaatggtccatcttagccaggttacggaactgaagtggagaaccacacagttaccccgagcattcaggacaatccacagagctaatttggacaattggacaaatgattattttcttttgcctcaactgaccagataattgtacacaagtctctgccatttgactccatggaatgtctctttgtgtagtaagaaagcctggccatagactggtaccatgacgtctgcccgagggtggcatggagttggggacaagacacacgcagctgacacccaccatctaactccgagtcctaaatcagaagcactttcatacgtgctaaaagtctctgcttgcacccagggttctcattagttccttctaatacccatcacttgggaggaggttgttttcaaaacagaattaaaaccatcaggcagcaaggttagaagtggcatctgggtggtcaagaaaattagtgttttttttt

SEQ ID NO: 335098 - DNA, 330 bp, Homo sapiens
agccccacaattccactcctacatacacattcaaaagaatcaaaactaagttctcaaacaagtacatgtacatgcatgttcacagtagcactattcaaaatagccaaaaattggaaacagtctaaatgtccatcaatggataaattgtgttacatacacacaatggaattttattcacccattaaaaaaagaagtactgatttatgctatgtagaggcaccccgaaaacatgctaaacgaaagaagctagacacaaaagtcttattattgcatgattccatttagatgaaatattcagaatatataaatccatagagacagaagggagat

SEQ ID NO: 335099 - DNA, 400 bp, Homo sapiens
cctctgcctcccaggttcaagcgattctcccacctcagcctccccagtagctgggattacaggggtgcagcaccacacctggctaattttttgcagagctgaggtttcactatgttggctaggctggtctcgaactcctgacctcaggtgatctacctaccttggcctcccaaagtgctgggattacaggcatgagccactgtgcctggccctaatgcaaactctatagttcatgcaagatttacctgctggctgtgtagcataaataaaccaaaggaaaacctgggcggggaccaggagctgcatcctgcatggcccctaagaagattggcttagatgaaattggaactctcctttatcatcttgctggatcatggggctggggttggggtcactggac

SEQ ID NO: 335100 - DNA, 460 bp, Homo sapiens
gctctcttgatgccacaaaaaatacagttgccccagccaattgatttgtgcagccacagcgtgaggcatcactattcacctggtaatggcacatgaaccacagtatactgaaggaaacagaactgccttagaaatagatatctataaatttagaaacttcagagatgtttcatgtaaattacttttcaaaacagctgatacttatatcctttaaatcaccataacttatcttaaaaaaatcttaattatttgtaaagagatctctaggtctttcttccgtgccttaatgtgcacatgatataatcttttcttgatgactcaagctcatcaatgtaaatatcaattattagactgttccataacagagtgattctttctggagtactgcagaatgtccaactgcttgtccctttattaactcatcctagactacttctaaaaacaaagatccctactgcct

SEQ ID NO: 335101 - DNA, 98 bp, Homo sapiens
tatttacagtaaataggtaataacttgatagtatatatcagtaaggctatttccatttttaaagatgataggaaatagtaccgttcctcagtgggtct

SEQ ID NO: 335102 - DNA, 177 bp, Homo sapiens
aaaaataattgtgagtctatttatagaccctatattcccttctattaatctttttaccaataccatagtgtcttgattactataactttataacagatcttgaaatcagatagaagtagtcctccaactccatccttctttttcaaagttgttttgattatttggctattgtagtgt

SEQ ID NO: 335103 - DNA, 176 bp, Homo sapiens
agacggggtttcatcatgtttgtcaggctggtctcgaactcctgacctcagcctcggcctcccaaagtgctgggattacaggtgtgagccactgcacctggccaacagagtcaggatttgaatccctggattcggtatcagcaggatttccgtgtcttacctgtcagcgccaacat

SEQ ID NO: 335104 - DNA, 405 bp, Homo sapiens
gagttggagaccagcatgggcaacgaaacacaaaatacaaaaaaattagtcaggcgtggtggtgcatgcctgtagtcccagctcctcaggaggctgagatgagagaattgcagcgagccatgatcataccactgcactccagcctgggcgacagagcgatactctgtctcaaaataagtaaattaattaattaattacaaaaattgacaaccagttggtctctatcttcaaaaaattctgctgggattctaattggaattgtgttacagttgtaggttaatctggggataactgacatatttgagtatttcaatccatgaaaacaatatgtctatccatctatttaggtcttctttattaatttatttcaccaagattttatagttttttttttttttttttttt

SEQ ID NO: 335105 - DNA, 356 bp, Homo sapiens
cactcctgcattgtttaccacatgttaatcttatgacgtcatttatacgtcattatctgtgtacttaactgttcttcctaccaacgtttattaagtacctatgatatatcaagggtatgtactaggcacttcacatgttattttatttaatttaattcctacaacagccctgtgagataggtattaccatccccatttcacagatcaggaatttgatgctgacagaagttaattaacttctcaaagtagcatccttactaaatggcatcactcattcaacaaattttattccaatccatgtctgctagattcctaacccatgggcttttcaatatagactggggaacccctttgag

SEQ ID NO: 335106 - DNA, 152 bp, Homo sapiens
tgaaacaagctaatatttttttaagatcttaccattttatgtattagctcatttaatcctcagtcaccgtatgtggtactactactgttcccattttacaaacgaggaaatgaaggcacacagaagctaataaagtactagtaaagcgcctg

SEQ ID NO: 335107 - DNA, 459 bp, Homo sapiens
gatttttataagcaaggccctgagagtcactttgacattcatccctggggaaagaggtctgtggcctaacattgccaggcaaggcctctactcaggagctcagtccaggactgtgggtgagaaaagctctggattcgagagtattcaaatatttgaccatttaagagttaggacaaaggatgatcctgtccccttgccatgtggccatgcatgtgtgcagtgttcccaggtgcttctgacttacagccaagtttgggctgtggttattgattgacagatactgatgcctttgtccaggaatggtggttgctgactgtgtgctctgccaccctgccttggaaccagcagggcatatgtgagtcctgtccagtctatactcaccagtgactttgccccttagcccgagtggttcaccctcacagtctctctgttagagaagtgagttgtgactatggggtt

SEQ ID NO: 335108 - DNA, 290 bp, Homo sapiens
gacccactgaaattaatggatactctcacatgactgactttattattaaatacttgctgtaatcacaactaggcataggaaaatcaagtagagaaatactgaatgcctagcatacaacgatctaagtgaaagttaataaaagtagctcttcagaaagacatctcatgtaaaattaaatttaaaactaaaaatttcatgaagtgacctgttaagagtttcaatttagaagctttacttttctaattttaaaatatcatgaatgaaatggtgtcttcatctaggtgcttctc

SEQ ID NO: 335109 - DNA, 426 bp, Homo sapiens
tgggtgggggagtgggggagatgtgggcctgctaagaaaaaaagcaaggcaggttgctgacaatgttgcccattattgtaatctgatcttggtgggcctcagtttcccatctgcaaaagtggaataagaaaatgtcacgaggtgcctgtgaagtttagacaaaataatcatcataatggtattattagtaatgctaataattaaagtctgactgagcactttgttgggcgatgcttaaacacaaggccctggggatgacagtgtgacagctctggctcgtttagactctaacacttactgcgtgtgatgaccctggacaaatgacttagcccttccaagattcaatttcctcatgtgaaaacaggacaagacctgatctagtaaggctgtcatgaagatttaatatgatcacaatgcatgtaaagt

SEQ ID NO: 335110 - DNA, 496 bp, Homo sapiens
gtctcacaaagaaatccaaaaagttaaaaaaaaagaaagctaggacaatttttcccaccttaaaatgattctgccacattatattcaacacagaaaatatcaaagatgaaaaagtaaagtgaattatttataactcaaaagagagagaaaatttctctttttagagactcttctgagaaagaatatctaacattcggggtgagaggtgcttgtggcccttggagaatcttatgacccatagctatgttcacattcagatttttttattggcttaaaaaaaagtatttagaaaaactaacttatggagactgcttgctttgccaagagaaatgagagaaccctattttattacccttgtgagtcatctattttcttggttctgcaaaaaaaattgttatgaaactcatcaaatattacttaggaataaaaccagtgtttgtgattcatctataaaacaaattaattcacacaattcagtataatcttgacatcacgg

SEQ ID NO: 335111 - DNA, 646 bp, Homo sapiens
gtcaaaaagcaaccacagggcttccacagccagagctgccatggtttttgttctgttttgttttggtaggaatttttaagataacattaaaaagaataagtggagctataggagctaggctcatctgcatctgttactgcaatcagggcccctactgtggcaatcagcagtctttccgtggctccaagtggtgtgtgagttcttgtcagcagtctcgtagaacttttcacatcagtgttccaagtttagaaaccagttaacccagcaatgccctttgctacttgtagatgtagagaatcaatgggctgtattcaccatgaggctgtgatacctccttttactctgacattccgaatgttgtcagtattacaaggcgatggttttggttttttatataaactggggtgtatatgtctggatgtatatccgtttaagattttatagtactgcagggtccaattgtgaagggttagatttaccaggaaaaaaaagattagtccacatgtaaagtagaaaatatttataagagctatcacaaatgtttactgtcctattacagcatcagacactagttctgtcatttattgtctctctgagaagactagctacaatgaatgttttgctttcttaattatgcctttgttac

SEQ ID NO: 335112 - DNA, 423 bp, Homo sapiens
ctgcctcagcctcctgagtagctgggattataggtgcctgccaccatgcccagctaatttttgtatttttagtaaagatgaggtttcatcatgttggccaggttagtctcgaaatcctgacctcgggatcctcccaccttagcctcccaaagtcctgagattataggcatgagccaccgcacctggccagaatagtgttttgtaaataaagttgacttcagtatcttaagaagtggtcattgtggggctgagcatgtgtttcagagtctgaagctctggtctggggctgaggctgggagctcagagtggagatccatcaggtggtgtgaagcagggtgggggatggaaggttccaggtctgaggaccagaagaggtagaggtagacgctcagagacgtggagggtggtgagtggcaggggaga

SEQ ID NO: 335113 - DNA, 297 bp, Homo sapiens
gtactctgctacctagaataagcgagtatgggcatattcccatcactgaagtcagatgagcaaagacctgtctcagggaaaggacagcttgatcccatcaagttttcaagttttgaggtcatttgagttccccaggaaagaggaaggctgtggtccccaactctgttggggtgtagatgcaggccgcccttcctccattccttcctgccagagactcaatgtgaatagtgtctgggccttggagtggggagaatctgctggcccttcacaccttcgctgtgggcccagcttccctcc

SEQ ID NO: 335114 - DNA, 452 bp, Homo sapiens
cctttgaataattgaagttgtaaagaaagcaaattaatgggtaaggaaactaggaagatgcatattggtgttcctgaaattttacaatgtactttaactctagtgcttagtataatttctttcatgttgaggcactggtaagtcctattctcctagataaaaatcttcagtgggattacgcctctgcgtttcatggcccaatgagagcttttgattttattacagattacaataagtcatagactgttctctcccttctggtttgagtgatactacacccttgccagcaccacagatggaaaaattgtaattaaagtgtctctgagaaatccttttctttgcaatcttcccaaatcgtccatatttttttgtgtatgttgaatgtatatctgaccatcaaataaaatactttcagaattgttctagaaaatatccttgcaataagattgaat

SEQ ID NO: 335115 - DNA, 2306 bp, Homo sapiens
tctctgaagccacagatctcttaagaactttctgtctccaaaccgtggctgctcgataaatcagacagaacagttaatcctcaatttaagcctgatctaacccctagaaacaggaattaaggataacctagacgacataaagaggataattaaagccagagagcacagaaataggcttctagcagacatcagagactataggccctatgcagacttggtttcagaaattcgtattcttttggtgggtccagttgggtctggaaagtccagttttttcaattcagtcaagtctatttttcatggccatgtgactggccaagccgtagtggggtctgatatcaccagcataaccgagcggtataggatatattctgttaaagatggaaaaaatggaaaatctctgccatttatgttgtgtgacactatggggctagatggggcagaaggagcaggactgtgcatggatgacattccccacatcttaaaaggttgtatgccagacagatatcagtttaattcccgtaaaccaattacacctgagcattctacttttatcacctctccatctctgaaggacaggattcactgtgtggcttatgtcttagacatcaactctattgacaatctctactctaaaatgttggcaaaagtgaagcaagttcacaaagaagtattaaactgtggtatagcatatgtggccttgcttactaaagtggatgattgcagtgaggttcttcaagacaactttttaaacatgagtagatctatgacttctcaaagccgggtcatgaatgtccataaaatgctaggcattcctatttccaatattttgatggttggaaattatgcttcagatttggaactggaccccatgaaggatattctcatcctctctgcactgaggcagatgctgcgggctgcagatgattttttagaagatttgcctcttgaggaaactggtgcaattgagagagcgttacagccctgcatttgagataagttgccttgattctgacatttggcccagcctgtactggtgtgccgcaatgagagtcaatctctattgacagcctgcttcagattttgcttttgttcgttttgccttctgtccttggaacagtcatatctcaagttcaaaggccaaaacctgagaagcggtgggctaagataggtcctactgcaaaccacccctccatatttccgtaccatttacaattcagtttctgtgacatctttttaaaccactggaggaaaaatgagatattctctaatttattcttctataacactctatatagagctatgtgagtactaatcacattgaataatagttataaaattattgtatagacatctgcttcttaaacagattgtgagttctttgagaaacagcgtggattttacttatctgtgtattcacagagcttagcacagtgcctggtaatgagcaagcatacttgccattacttttccttcccactctctccaacatcacattcactttaaatttttctgtatatagaaaggaaaactagcctgggcaacatgatgaaaccccatctccactgcaaaaaaaaaaaaaaaaaataagaaagaacaaaacaaaccccacaaaaattagctgggtatgatggcacgtgcctgtagtcccagttactcaggatgattgattgagccttggaggtggaggctacagtgagctgagattgtgccactgtactctagccagggagaaagagtgagatcctggctcaaaaaaaccaaataaaacaaaacaaacaaacgaaaaacagaaaggaagactgaaagagaatgaaaagctggggagaggaaataaaaataaagaaggaagagtgtttcatttatatctgaatgaaaatatgaatgactctaagtaattgaattaattaaaatgagccaacttttttttaacaatttacattttatttctatgggaaaaaataaatattcctcttctaacaaacccatgcttgattttcattaattgaattccaaatcatcctagccatgtgtccttccatttaggttactggggcaaatcagtaagaaagttcttatatttatgctccaaataattctgaagtcctcttactagctgtgaaagctagtactattaagaaagaaaacaaaattcccaaaagatagctttcacttttttttttccttaaagacttcctaattctcttctccaaattcttagtcttcttcaaaataatatgctttggttcaatagttatccacattctgacagtctaatttagttttaatcagaattatactcatct

SEQ ID NO: 335116 - DNA, 2724 bp, Homo sapiens
tctctgaagccacagatctcttaagaactttctgtctccaaaccgtggctgctcgataaatcagacagaacagttaatcctcaatttaagcctgatctaacccctagaaacagatatagaacaatggaagtgacaacaagattgacatggaatgatgaaaatcatctgcgcaagctgcttggaaatgtttctttgagtcttctctataagtctagtgttcatggaggtagcattgaagatatggttgaaagatgcagccgtcagggatgtactataacaatggcttacattgattacaatatgattgtagcctttatgcttggaaattatattaatttacgtgaaagttctacagagccaaatgattccctatggttttcacttcaaaagaaaaatgacaccactgaaatagaaactttactcttaaatacagcaccaaaaattattgatgagcaactggtgtgtcgtttatcgaaaacggatattttcattatatgtcgagataataaaatttatctagataaaatgataacaagaaacttgaaactaaggttttatggccaccgtcagtatttggaatgtgaagtttttcgagttgaaggaattaaggataacctagacgacataaagaggataattaaagccagagagcacagaaataggcttctagcagacatcagagactataggccctatgcagacttggtttcagaaattcgtattcttttggtgggtccagttgggtctggaaagtccagttttttcaattcagtcaagtctatttttcatggccatgtgactggccaagccgtagtggggtctgatatcaccagcataaccgagcggtataggatatattctgttaaagatggaaaaaatggaaaatctctgccatttatgttgtgtgacactatggggctagatggggcagaaggagcaggactgtgcatggatgacattccccacatcttaaaaggttgtatgccagacagatatcagtttaattcccgtaaaccaattacacctgagcattctacttttatcacctctccatctctgaaggacaggattcactgtgtggcttatgtcttagacatcaactctattgacaatctctactctaaaatgttggcaaaagtgaagcaagttcacaaagaagtattaaactgtggtatagcatatgtggccttgcttactaaagtggatgattgcagtgaggttcttcaagacaactttttaaacatgagtagatctatgacttctcaaagccggatttggaactggaccccatgaaggatattctcatcctctctgcactgaggcagatgctgcgggctgcagatgattttttagaagatttgcctcttgaggaaactggtgcaattgagagagcgttacagccctgcatttgagataagttgccttgattctgacatttggcccagcctgtactggtgtgccgcaatgagagtcaatctctattgacagcctgcttcagattttgcttttgttcgttttgccttctgtccttggaacagtcatatctcaagttcaaaggccaaaacctgagaagcggtgggctaagataggtcctactgcaaaccacccctccatatttccgtaccatttacaattcagtttctgtgacatctttttaaaccactggaggaaaaatgagatattctctaatttattcttctataacactctatatagagctatgtgagtactaatcacattgaataatagttataaaattattgtatagacatctgcttcttaaacagattgtgagttctttgagaaacagcgtggattttacttatctgtgtattcacagagcttagcacagtgcctggtaatgagcaagcatacttgccattacttttccttcccactctctccaacatcacattcactttaaatttttctgtatatagaaaggaaaactagcctgggcaacatgatgaaaccccatctccactgcaaaaaaaaaaaaaaaaaataagaaagaacaaaacaaaccccacaaaaattagctgggtatgatggcacgtgcctgtagtcccagttactcaggatgattgattgagccttggaggtggaggctacagtgagctgagattgtgccactgtactctagccagggagaaagagtgagatcctggctcaaaaaaaccaaataaaacaaaacaaacaaacgaaaaacagaaaggaagactgaaagagaatgaaaagctggggagaggaaataaaaataaagaaggaagagtgtttcatttatatctgaatgaaaatatgaatgactctaagtaattgaattaattaaaatgagccaacttttttttaacaatttacattttatttctatgggaaaaaataaatattcctcttctaacaaacccatgcttgattttcattaattgaattccaaatcatcctagccatgtgtccttccatttaggttactggggcaaatcagtaagaaagttcttatatttatgctccaaataattctgaagtcctcttactagctgtgaaagctagtactattaagaaagaaaacaaaattcccaaaagatagctttcacttttttttttccttaaagacttcctaattctcttctccaaattcttagtcttcttcaaaataatatgctttggttcaatagttatccacattctgacagtctaatttagttttaatcagaattatactcatct

SEQ ID NO: 335117 - DNA, 2061 bp, Homo sapiens
tctctgaagccacagatctcttaagaactttctgtctccaaaccgtggctgctcgataaatcagacagaacagttaatcctcaatttaagcctgatctaacccctagaaacagtataggatatattctgttaaagatggaaaaaatggaaaatctctgccatttatgttgtgtgacactatggggctagatggggcagaaggagcaggactgtgcatggatgacattccccacatcttaaaaggttgtatgccagacagatatcagtttaattcccgtaaaccaattacacctgagcattctacttttatcacctctccatctctgaaggacaggattcactgtgtggcttatgtcttagacatcaactctattgacaatctctactctaaaatgttggcaaaagtgaagcaagttcacaaagaagtattaaactgtggtatagcatatgtggccttgcttactaaagtggatgattgcagtgaggttcttcaagacaactttttaaacatgagtagatctatgacttctcaaagccgggtcatgaatgtccataaaatgctaggcattcctatttccaatattttgatggttggaaattatgcttcagatttggaactggaccccatgaaggatattctcatcctctctgcactgaggcagatgctgcgggctgcagatgattttttagaagatttgcctcttgaggaaactggtgcaattgagagagcgttacagccctgcatttgagataagttgccttgattctgacatttggcccagcctgtactggtgtgccgcaatgagagtcaatctctattgacagcctgcttcagattttgcttttgttcgttttgccttctgtccttggaacagtcatatctcaagttcaaaggccaaaacctgagaagcggtgggctaagataggtcctactgcaaaccacccctccatatttccgtaccatttacaattcagtttctgtgacatctttttaaaccactggaggaaaaatgagatattctctaatttattcttctataacactctatatagagctatgtgagtactaatcacattgaataatagttataaaattattgtatagacatctgcttcttaaacagattgtgagttctttgagaaacagcgtggattttacttatctgtgtattcacagagcttagcacagtgcctggtaatgagcaagcatacttgccattacttttccttcccactctctccaacatcacattcactttaaatttttctgtatatagaaaggaaaactagcctgggcaacatgatgaaaccccatctccactgcaaaaaaaaaaaaaaaaaataagaaagaacaaaacaaaccccacaaaaattagctgggtatgatggcacgtgcctgtagtcccagttactcaggatgattgattgagccttggaggtggaggctacagtgagctgagattgtgccactgtactctagccagggagaaagagtgagatcctggctcaaaaaaaccaaataaaacaaaacaaacaaacgaaaaacagaaaggaagactgaaagagaatgaaaagctggggagaggaaataaaaataaagaaggaagagtgtttcatttatatctgaatgaaaatatgaatgactctaagtaattgaattaattaaaatgagccaacttttttttaacaatttacattttatttctatgggaaaaaataaatattcctcttctaacaaacccatgcttgattttcattaattgaattccaaatcatcctagccatgtgtccttccatttaggttactggggcaaatcagtaagaaagttcttatatttatgctccaaataattctgaagtcctcttactagctgtgaaagctagtactattaagaaagaaaacaaaattcccaaaagatagctttcacttttttttttccttaaagacttcctaattctcttctccaaattcttagtcttcttcaaaataatatgctttggttcaatagttatccacattctgacagtctaatttagttttaatcagaattatactcatct

SEQ ID NO: 335118 - DNA, 2569 bp, Homo sapiens
tctctgaagccacagatctcttaagaactttctgtctccaaaccgtggctgctcgataaatcagacagaacagttaatcctcaatttaagcctgatctaacccctagaaacagatatagaacaatggaagtgacaacaagattgacatggaatgatgaaaatcatctgcgcaagctgcttggaaatgtttctttgagtcttctctataagtctagtgttcatggaggtagcattgaagatatggttgaaagatgcagccgtcagggatgtactataacaatggcttacattgattacaatatgattgtagcctttatgcttggaaattatattaatttacgtgaaagttctacagagccaaatgattccctatggttttcacttcaaaagaaaaatgacaccactgaaatagaaactttactcttaaatacagcaccaaaaattattgatgagcaactggtgtgtcgtttatcgaaaacggatattttcattatatgtcgagataataaaatttatctagataaaatgataacaagaaacttgaaactaaggttttatggccaccgtcagtatttggaatgtgaagtttttcgagttgaaggaattaaggataacctagacgacataaagaggataattaaagccagagagcacagaaataggcttctagcagacatcagagactataggccctatgcagacttggtttcagaaattcgtattcttttggtgggtccagttgggtctggaaagtccagttttttcaattcagtcaagtctatttttcatggccatgtgactggccaagccgtagtggggtctgatatcaccagcataaccgagcggtataggatatattctgttaaagatggaaaaaatggaaaatctctgccatttatgttgtgtgacactatggggctagatggggcagaaggagcaggactgtgcatggatgacattccccacatcttaaaaggttgtatgccagacagatatcagtttaattcccgtaaaccaattacacctgagcattctacttttatcacctctccatctctgaaggacaggattcactgtgtggcttatgtcttagacatcaactctattgacaatctctactctaaaatgttggcaaaagtgaagcaagttcacaaagaagtattaaactgtggtatagcatatgtggccttgcttactaaagtggatgattgcagtgaggttcttcaagacaactttttaaacatgagtagatctatgacttctcaaagccgggtcatgaatgtccataaaatgctaggcattcctatttccaatattttgatggttggaaattatgcttcaggattttgcttttgttcgttttgccttctgtccttggaacagtcatatctcaagttcaaaggccaaaacctgagaagcggtgggctaagataggtcctactgcaaaccacccctccatatttccgtaccatttacaattcagtttctgtgacatctttttaaaccactggaggaaaaatgagatattctctaatttattcttctataacactctatatagagctatgtgagtactaatcacattgaataatagttataaaattattgtatagacatctgcttcttaaacagattgtgagttctttgagaaacagcgtggattttacttatctgtgtattcacagagcttagcacagtgcctggtaatgagcaagcatacttgccattacttttccttcccactctctccaacatcacattcactttaaatttttctgtatatagaaaggaaaactagcctgggcaacatgatgaaaccccatctccactgcaaaaaaaaaaaaaaaaaataagaaagaacaaaacaaaccccacaaaaattagctgggtatgatggcacgtgcctgtagtcccagttactcaggatgattgattgagccttggaggtggaggctacagtgagctgagattgtgccactgtactctagccagggagaaagagtgagatcctggctcaaaaaaaccaaataaaacaaaacaaacaaacgaaaaacagaaaggaagactgaaagagaatgaaaagctggggagaggaaataaaaataaagaaggaagagtgtttcatttatatctgaatgaaaatatgaatgactctaagtaattgaattaattaaaatgagccaacttttttttaacaatttacattttatttctatgggaaaaaataaatattcctcttctaacaaacccatgcttgattttcattaattgaattccaaatcatcctagccatgtgtccttccatttaggttactggggcaaatcagtaagaaagttcttatatttatgctccaaataattctgaagtcctcttactagctgtgaaagctagtactattaagaaagaaaacaaaattcccaaaagatagctttcacttttttttttccttaaagacttcctaattctcttctccaaattcttagtcttcttcaaaataatatgctttggttcaatagttatccacattctgacagtctaatttagttttaatcagaattatactcatct

SEQ ID NO: 335119 - DNA, 1586 bp, Homo sapiens
ttggcaggacactagtgcaggctgggccaaagggcaaaatcaaggcaacttatctcaaagccgggtcatgaatgtccataaaatgctaggcattcctatttccaatattttgatggttggaaattatgcttcagatttggaactggaccccatgaaggatattctcatcctctctgcactgaggcagatgctgcgggctgcagatgattttttagaagatttgcctcttgaggaaactggtgcaattgagagagcgttacagccctgcatttgagataagttgccttgattctgacatttggcccagcctgtactggtgtgccgcaatgagagtcaatctctattgacagcctgcttcagattttgcttttgttcgttttgccttctgtccttggaacagtcatatctcaagttcaaaggccaaaacctgagaagcggtgggctaagataggtcctactgcaaaccacccctccatatttccgtaccatttacaattcagtttctgtgacatctttttaaaccactggaggaaaaatgagatattctctaatttattcttctataacactctatatagagctatgtgagtactaatcacattgaataatagttataaaattattgtatagacatctgcttcttaaacagattgtgagttctttgagaaacagcgtggattttacttatctgtgtattcacagagcttagcacagtgcctggtaatgagcaagcatacttgccattacttttccttcccactctctccaacatcacattcactttaaatttttctgtatatagaaaggaaaactagcctgggcaacatgatgaaaccccatctccactgcaaaaaaaaaaaaaaaaaataagaaagaacaaaacaaaccccacaaaaattagctgggtatgatggcacgtgcctgtagtcccagttactcaggatgattgattgagccttggaggtggaggctacagtgagctgagattgtgccactgtactctagccagggagaaagagtgagatcctggctcaaaaaaaccaaataaaacaaaacaaacaaacgaaaaacagaaaggaagactgaaagagaatgaaaagctggggagaggaaataaaaataaagaaggaagagtgtttcatttatatctgaatgaaaatatgaatgactctaagtaattgaattaattaaaatgagccaacttttttttaacaatttacattttatttctatgggaaaaaataaatattcctcttctaacaaacccatgcttgattttcattaattgaattccaaatcatcctagccatgtgtccttccatttaggttactggggcaaatcagtaagaaagttcttatatttatgctccaaataattctgaagtcctcttactagctgtgaaagctagtactattaagaaagaaaacaaaattcccaaaagatagctttcacttttttttttccttaaagacttcctaattctcttctccaaattcttagtcttcttcaaaataatatgctttggttcaatagttatccacattctgacagtctaatttagttttaatcagaattatactcatct

SEQ ID NO: 335120 - DNA, 1476 bp, Homo sapiens
  misc_feature (1389)..(1389): n is a, c, g, or t
  misc_feature (1398)..(1398): n is a, c, g, or t
tctctgaagccacagatctcttaagaactttctgtctccaaaccgtggctgctcgataaatcagacagaacagttaatcctcaatttaagcctgatctaacccctagaaacagatatagaacaatggaagtgacaacaagattgacatggaatgatgaaaatcatctgcgcaagctgcttggaaatgtttctttgagtcttctctataagtctagtgttcatggaggtagcattgaagatatggttgaaagatgcagccgtcagggatgtactataacaatggcttacattgattacaatatgattgtagcctttatgcttggaaattatattaatttacgtgaaagttctacagagccaaatgattccctatggttttcacttcaaaagaaaaatgacaccactgaaatagaaactttactcttaaatacagcaccaaaaattattgatgagcaactggtgtgtcgtttatcgaaaacggatattttcattatatgtcgagataataaaatttatctagataaaatgataacaagaaacttgaaactaaggttttatggccaccgtcagtatttggaatgtgaagtttttcgagttgaaggaattaaggataacctagacgacataaagaggataattaaagccagagagcacagaaataggcttctagcagacatcagagactataggccctatgcagacttggtttcagaaattcgtattcttttggtgggtccagttgggtctggaaagtccagttttttcaattcagtcaagtctatttttcatggccatgtgactggccaagccgtagtggggtctgatatcaccagcataaccgagcggtataggatatattctgttaaagatggaaaaaatggaaaatctctgccatttatgttgtgtgacactatggggctagatggggcagaaggagcaggactgtgcatggatgacattccccacatcttaaaaggttgtatgccagacagatatcaggacaggattcactgtgtggcttatgtcttagacatcaactctattgacaatctctactctaaaatgttggcaaaagtgaagcaagttcacaaagaagtattaaactgtggtatagcatatgtggccttgcttactaaagtggatgattgcagtgaggttcttcaagacaactttttaaacatgagtagatctatgacttctcaaagccgggtcatgaatgtccataaaatgctaggcattcctatttccaatattttgatggttggaaattatgcttcagatttggaactggaccccatgaaggatattctcatcctctctgcactgaggcagatgctgcgggctgcagatgattttttagaagatttgcctcttgaggaaactggtgcnattgagagngcgttacagcctagcattttatggacattcatgacccggctttgagaagtcatagatctactcatgtgtaaaaagttg

SEQ ID NO: 335121 - DNA, 1042 bp, Homo sapiens
tctctgaagccacagatctcttaagaactttctgtctccaaaccgtggctgctcgataaatcagacagaacagttaatcctcaatttaagcctgatctaacccctagaaacagatatagaacaatggaagtgacaacaagattgacatggaatgatgaaaatcatctgcgcaagctgcttggaaatgtttctttgagtcttctctataagtctagtgttcatggaggtagcattgaagatatggttgaaagatgcagccgtcagggatgtactataacaatggcttacattgattacaatatgattgtagcctttatgcttggaaattatattaatttacgtgaaagttctacagagccaaatgattccctatggttttcacttcaaaagaaaaatgacaccactgaaatagaaactttactcttaaatacagcaccaaaaattattgatgagcaactggtgtgtcgtttatcgaaaacggatattttcattatatgtcgagataataaaatttatctagataaaatgataacaagaaacttgaaactaaggttttatggccaccgtcagtatttggaatgtgaagtttttcgagttgaaggaattaaggataacctagacgacataaagaggataattaaagccagagagcacagaaataggcttctagcagacatcagagactataggccctatgcagacttggtttcagaaattcgtattcttttggtgggtccagttgggtctggaaagtccagttttttcaattcagtcaagtctatttttcatggccatgtgactggccaagccgtagtggggtctgatatcaccagcataaccgagcggggcaatcctaatatacaattaaatgctaaatcaaatggaaaataggagtaaaattttgatcagaaccacctccattgtgctatattatacagagaagctttcaaattttatggatggaagaagcagttatataaagaatactttttagtatttgtataaaaaacaacaaaaaattaaaaaccctatgaaaatcttt

SEQ ID NO: 335122 - DNA, 424 bp, Homo sapiens
tctctgaagccacagatctcttaagaactttctgtctccaaaccgtggctgctcgataaatcagacagaacagttaatcctcaatttaagcctgatctaacccctagaaacaggtaagcgactttttaatgaaacatagtatttgtacgtatttatggggttatgtgtgatattttgatacaagcatacaatgtaatgaccaaatcaggatcattgggaaatccatcacctcaaccatttatcatttctttgtatttggaacattccaaattttctcttctagctatttcaaaatagacaataaattattgttaactatagttaaactgttgtgctatgaacacaagaacttattccttctatgtagctgtatttttgtaaccattaaccaacctcttttcatcatctccttcctctgactttc

SEQ ID NO: 335123 - DNA, 2794 bp, Homo sapiens
tctctgaagccacagatctcttaagaactttctgtctccaaaccgtggctgctcgataaatcagacagaacagttaatcctcaatttaagcctgatctaacccctagaaacagatatagaacaatggaagtgacaacaagattgacatggaatgatgaaaatcatctgcgcaagctgcttggaaatgtttctttgagtcttctctataagtctagtgttcatggaggtagcattgaagatatggttgaaagatgcagccgtcagggatgtactataacaatggcttacattgattacaatatgattgtagcctttatgcttggaaattatattaatttacgtgaaagttctacagagccaaatgattccctatggttttcacttcaaaagaaaaatgacaccactgaaatagaaactttactcttaaatacagcaccaaaaattattgatgagcaactggtgtgtcgtttatcgaaaacggatattttcattatatgtcgagataataaaatttatctagataaaatgataacaagaaacttgaaactaaggttttatggccaccgtcagtatttggaatgtgaagtttttcgagttgaaggaattaaggataacctagacgacataaagaggataattaaagccagagagcacagaaataggcttctagcagacatcagagactataggccctatgcagacttggtttcagaaattcgtattcttttggtgggtccagttgggtctggaaagtccagttttttcaattcagtcaagtctatttttcatggccatgtgactggccaagccgtagtggggtctgatatcaccagcataaccgagcggtataggatatattctgttaaagatggaaaaaatggaaaatctctgccatttatgttgtgtgacactatggggctagatggggcagaaggagcaggactgtgcatggatgacattccccacatcttaaaaggttgtatgccagacagatatcagtttaattcccgtaaaccaattacacctgagcattctacttttatcacctctccatctctgaaggacaggattcactgtgtggcttatgtcttagacatcaactctattgacaatctctactctaaaatgttggcaaaagtgaagcaagttcacaaagaagtattaaactgtggtatagcatatgtggccttgcttactaaagtggatgattgcagtgaggttcttcaagacaactttttaaacatgagtagatctatgacttctcaaagccgggtcatgaatgtccataaaatgctaggcattcctatttccaatattttgatggttggaaattatgcttcagatttggaactggaccccatgaaggatattctcatcctctctgcactgaggcagatgctgcgggctgcagatgattttttagaagatttgcctcttgaggaaactggtgcaattgagagagcgttacagccctgcatttgagataagttgccttgattctgacatttggcccagcctgtactggtgtgccgcaatgagagtcaatctctattgacagcctgcttcagattttgcttttgttcgttttgccttctgtccttggaacagtcatatctcaagttcaaaggccaaaacctgagaagcggtgggctaagataggtcctactgcaaaccacccctccatatttccgtaccatttacaattcagtttctgtgacatctttttaaaccactggaggaaaaatgagatattctctaatttattcttctataacactctatatagagctatgtgagtactaatcacattgaataatagttataaaattattgtatagacatctgcttcttaaacagattgtgagttctttgagaaacagcgtggattttacttatctgtgtattcacagagcttagcacagtgcctggtaatgagcaagcatacttgccattacttttccttcccactctctccaacatcacattcactttaaatttttctgtatatagaaaggaaaactagcctgggcaacatgatgaaaccccatctccactgcaaaaaaaaaaaaaaaaaataagaaagaacaaaacaaaccccacaaaaattagctgggtatgatggcacgtgcctgtagtcccagttactcaggatgattgattgagccttggaggtggaggctacagtgagctgagattgtgccactgtactctagccagggagaaagagtgagatcctggctcaaaaaaaccaaataaaacaaaacaaacaaacgaaaaacagaaaggaagactgaaagagaatgaaaagctggggagaggaaataaaaataaagaaggaagagtgtttcatttatatctgaatgaaaatatgaatgactctaagtaattgaattaattaaaatgagccaacttttttttaacaatttacattttatttctatgggaaaaaataaatattcctcttctaacaaacccatgcttgattttcattaattgaattccaaatcatcctagccatgtgtccttccatttaggttactggggcaaatcagtaagaaagttcttatatttatgctccaaataattctgaagtcctcttactagctgtgaaagctagtactattaagaaagaaaacaaaattcccaaaagatagctttcacttttttttttccttaaagacttcctaattctcttctccaaattcttagtcttcttcaaaataatatgctttggttcaatagttatccacattctgacagtctaatttagttttaatcagaattatactcatct

SEQ ID NO: 335124 - DNA, 2737 bp, Homo sapiens
  misc_feature (16)..(18): n is a, c, g, or t
  misc_feature (42)..(42): n is a, c, g, or t
  misc_feature (46)..(47): n is a, c, g, or t
  misc_feature (56)..(56): n is a, c, g, or t
ccttgaagagcatagnnnagtgaccctctctttatattaacncacnncgctacagnatatagaacaatggaagtgacaacaagattgacatggaatgatgaaaatcatctgcgcaagctgcttggaaatgtttctttgagtcttctctataagtctagtgttcatggaggtagcattgaagatatggttgaaagatgcagccgtcagggatgtactataacaatggcttacattgattacaatatgattgtagcctttatgcttggaaattatattaatttacgtgaaagttctacagagccaaatgattccctatggttttcacttcaaaagaaaaatgacaccactgaaatagaaactttactcttaaatacagcaccaaaaattattgatgagcaactggtgtgtcgtttatcgaaaacggatattttcattatatgtcgagataataaaatttatctagataaaatgataacaagaaacttgaaactaaggttttatggccaccgtcagtatttggaatgtgaagtttttcgagttgaaggaattaaggataacctagacgacataaagaggataattaaagccagagagcacagaaataggcttctagcagacatcagagactataggccctatgcagacttggtttcagaaattcgtattcttttggtgggtccagttgggtctggaaagtccagttttttcaattcagtcaagtctatttttcatggccatgtgactggccaagccgtagtggggtctgatatcaccagcataaccgagcggtataggatatattctgttaaagatggaaaaaatggaaaatctctgccatttatgttgtgtgacactatggggctagatggggcagaaggagcaggactgtgcatggatgacattccccacatcttaaaaggttgtatgccagacagatatcagtttaattcccgtaaaccaattacacctgagcattctacttttatcacctctccatctctgaaggacaggattcactgtgtggcttatgtcttagacatcaactctattgacaatctctactctaaaatgttggcaaaagtgaagcaagttcacaaagaagtattaaactgtggtatagcatatgtggccttgcttactaaagtggatgattgcagtgaggttcttcaagacaactttttaaacatgagtagatctatgacttctcaaagccgggtcatgaatgtccataaaatgctaggcattcctatttccaatattttgatggttggaaattatgcttcagatttggaactggaccccatgaaggatattctcatcctctctgcactgaggcagatgctgcgggctgcagatgattttttagaagatttgcctcttgaggaaactggtgcaattgagagagcgttacagccctgcatttgagataagttgccttgattctgacatttggcccagcctgtactggtgtgccgcaatgagagtcaatctctattgacagcctgcttcagattttgcttttgttcgttttgccttctgtccttggaacagtcatatctcaagttcaaaggccaaaacctgagaagcggtgggctaagataggtcctactgcaaaccacccctccatatttccgtaccatttacaattcagtttctgtgacatctttttaaaccactggaggaaaaatgagatattctctaatttattcttctataacactctatatagagctatgtgagtactaatcacattgaataatagttataaaattattgtatagacatctgcttcttaaacagattgtgagttctttgagaaacagcgtggattttacttatctgtgtattcacagagcttagcacagtgcctggtaatgagcaagcatacttgccattacttttccttcccactctctccaacatcacattcactttaaatttttctgtatatagaaaggaaaactagcctgggcaacatgatgaaaccccatctccactgcaaaaaaaaaaaaaaaaaataagaaagaacaaaacaaaccccacaaaaattagctgggtatgatggcacgtgcctgtagtcccagttactcaggatgattgattgagccttggaggtggaggctacagtgagctgagattgtgccactgtactctagccagggagaaagagtgagatcctggctcaaaaaaaccaaataaaacaaaacaaacaaacgaaaaacagaaaggaagactgaaagagaatgaaaagctggggagaggaaataaaaataaagaaggaagagtgtttcatttatatctgaatgaaaatatgaatgactctaagtaattgaattaattaaaatgagccaacttttttttaacaatttacattttatttctatgggaaaaaataaatattcctcttctaacaaacccatgcttgattttcattaattgaattccaaatcatcctagccatgtgtccttccatttaggttactggggcaaatcagtaagaaagttcttatatttatgctccaaataattctgaagtcctcttactagctgtgaaagctagtactattaagaaagaaaacaaaattcccaaaagatagctttcacttttttttttccttaaagacttcctaattctcttctccaaattcttagtcttcttcaaaataatatgctttggttcaatagttatccacattctgacagtctaatttagttttaatcagaattatactcatct

SEQ ID NO: 335125 - DNA, 1539 bp, Homo sapiens
  misc_feature (1452)..(1452): n is a, c, g, or t
  misc_feature (1461)..(1461): n is a, c, g, or t
tctctgaagccacagatctcttaagaactttctgtctccaaaccgtggctgctcgataaatcagacagaacagttaatcctcaatttaagcctgatctaacccctagaaacagatatagaacaatggaagtgacaacaagattgacatggaatgatgaaaatcatctgcgcaagctgcttggaaatgtttctttgagtcttctctataagtctagtgttcatggaggtagcattgaagatatggttgaaagatgcagccgtcagggatgtactataacaatggcttacattgattacaatatgattgtagcctttatgcttggaaattatattaatttacgtgaaagttctacagagccaaatgattccctatggttttcacttcaaaagaaaaatgacaccactgaaatagaaactttactcttaaatacagcaccaaaaattattgatgagcaactggtgtgtcgtttatcgaaaacggatattttcattatatgtcgagataataaaatttatctagataaaatgataacaagaaacttgaaactaaggttttatggccaccgtcagtatttggaatgtgaagtttttcgagttgaaggaattaaggataacctagacgacataaagaggataattaaagccagagagcacagaaataggcttctagcagacatcagagactataggccctatgcagacttggtttcagaaattcgtattcttttggtgggtccagttgggtctggaaagtccagttttttcaattcagtcaagtctatttttcatggccatgtgactggccaagccgtagtggggtctgatatcaccagcataaccgagcggtataggatatattctgttaaagatggaaaaaatggaaaatctctgccatttatgttgtgtgacactatggggctagatggggcagaaggagcaggactgtgcatggatgacattccccacatcttaaaaggttgtatgccagacagatatcagtttaattcccgtaaaccaattacacctgagcattctacttttatcacctctccatctctgaaggacaggattcactgtgtggcttatgtcttagacatcaactctattgacaatctctactctaaaatgttggcaaaagtgaagcaagttcacaaagaagtattaaactgtggtatagcatatgtggccttgcttactaaagtggatgattgcagtgaggttcttcaagacaactttttaaacatgagtagatctatgacttctcaaagccgggtcatgaatgtccataaaatgctaggcattcctatttccaatattttgatggttggaaattatgcttcagatttggaactggaccccatgaaggatattctcatcctctctgcactgaggcagatgctgcgggctgcagatgattttttagaagatttgcctcttgaggaaactggtgcnattgagagngcgttacagcctagcattttatggacattcatgacccggctttgagaagtcatagatctactcatgtgtaaaaagttg

SEQ ID NO: 335126 - DNA, 1073 bp, Homo sapiens
tctctgaagccacagatctcttaagaactttctgtctccaaaccgtggctgctcgataaatcagacagaacagttaatcctcaatttaagcctgatctaacccctagaaacagatatagaacaatggaagtgacaacaagattgacatggaatgatgaaaatcatctgcgcaagctgcttggaaatgtttctttgagtcttctctataagtctagtgttcatggaggtagcattgaagatatggttgaaagatgcagccgtcagggatgtactataacaatggcttacattgattacaatatgattgtagcctttatgcttggaaattatattaatttacgtgaaagttctacagagccaaatgattccctatggttttcacttcaaaagaaaaatgacaccactgaaatagaaactttactcttaaatacagcaccaaaaattattgatgagcaactggtgtgtcgtttatcgaaaacggatattttcattatatgtcgagataataaaatttatctagataaaatgataacaagaaacttgaaactaaggttttatggccaccgtcagtatttggaatgtgaagtttttcgagttgaaggaattaaggataacctagacgacataaagaggataattaaagccagagagcacagaaataggcttctagcagacatcagagactataggccctatgcagacttggtttcagaaattcgtattcttttggtgggtccagttgggtctggaaagtccagttttttcaattcagtcaagtctatttttcatggccatgtgactggccaagccgtagtggggtctgatatcaccagcataaccgagcggattacaataagtcatagactgttctctcccttctggtttgagtgatactacacccttgccagcaccacagatggaaaaattgtaattaaagtgtctctgagaaatccttttctttgcaatcttcccaaatcgtccatatttttttgtgtatgttgaatgtatatctgaccatcaaataaaatactttcagaattgttctagaaaatatccttgcaataagattgaat

SEQ ID NO: 335127 - DNA, 1433 bp, Homo sapiens
cgaaccttcccagttccaaagcccaagaagctgggactgtgagatccacgttcccaaggctccccggtgctttccagcagcactcagggttggcaagagctggcttcagtatactgttatttcaggaatgaggcccgcacaaaataaaagcatttgagaaacggaaaggaaaaaaaaggagtgaaaataggaaggcttaaaaaaaaaaccggaaagaaatagacgcccacccttattttccctccaatgtcaacaagcaaaacgaaaatatttccagggtgatcgctcgcagctacccgcttccaattcggattagaagctgaggctggagcggcgaggagaaaacgacatcgagtcaccccgcgcgtgagcgacgctctggagcaggagagaaggaaaaggaagagacacacgtatatagcatgtgttacctgatttatttcgagattgtttggtactgttttctctctgggcacctctcatttcggaaggccatcagaggcgcccactactgagcggccccggccgccgcagcagcacccggagccccagtcccggtttccccgcggtgccggagcccggagctcgccgccgcccaggcctcaggaatcgagtaagtaacccctgtttggccccgcgctcctctgcccacttcctcctcctcatctcatcgctcccaaagctctcacaacacctcctcccccgaagtaaaggacacccccgcacacacgccagcggtgggccttatctccccccttatccaaagctgcgctagactattacctacaaagggcacaattttcctgctggctcagaaatgccagacactggcctgcaaggccgactcggaaaagtagtgcctcgcctctacctcctccatttcctgccctctcgcatcctctccctgcactcccactcttcccactaccaccaccacccccgctttcaaaaataaaattggatacaaactttaatcactaaggacaaatattgacgcttaaacgaaaatgacccagtacaatgaggaggaagccggaaatgtgagctattggccctaggaggggaatttcggtggagcggagccggcggggtggagggggtggcgggggcgcagggaagggctgcggcaccgcgtgctcccgccggcgtatccctacgcggctccgcgcggcctcggggtccgaggcccgcggagagggggaggcgagcgcccgagggggcggcagccggcgggcggggcgggggtgggtgggcccggcccctccgattggtcgacggcgagagagacgctcccgcacgccgccagctctgattggcccagcggtaggaaaggttaaaccaaaaatttttttacagccctagtgtgcgcctgtagctcggaaaattaattgtggctatagccgcctcgatcgctgtctccccagcctcgccgc

SEQ ID NO: 335128 - DNA, 246 bp, Homo sapiens
gaggagagagagagagagagagagagagagagagagagagagagagagagagagagagagagagagagagagagagagagagagagagagagagagcctgtgttgcgcaaatgccgcataaatttgagtgattgttaatgttgtcttaaaatttcttgattgtgatactgtggtcatatgcccgtgtttgtcacttacaaaaatgtttactatgaacacacagaaataaaaaataggctaaattca

SEQ ID NO: 335129 - DNA, 3167 bp, Homo sapiens
  misc_feature (1087)..(1087): n is a, c, g, or t
  misc_feature (1091)..(1091): n is a, c, g, or t
  misc_feature (1098)..(1098): n is a, c, g, or t
  misc_feature (1135)..(1135): n is a, c, g, or t
  misc_feature (1152)..(1152): n is a, c, g, or t
cgaaccttcccagttccaaagcccaagaagctgggactgtgagatccacgttcccaaggctccccggtgctttccagcagcactcagggttggcaagagctggcttcagtatactgttatttcaggaatgaggcccgcacaaaataaaagcatttgagaaacggaaaggaaaaaaaaggagtgaaaataggaaggcttaaaaaaaaaaccggaaagaaatagacgcccacccttattttccctccaatgtcaacaagcaaaacgaaaatatttccagggtgatcgctcgcagctacccgcttccaattcggattagaagctgaggctggagcggcgaggagaaaacgacatcgagtcaccccgcgcgtgagcgacgctctggagcaggagagaaggaaaaggaagagacacacgtatatagcatgtgttacctgatttatttcgagattgtttggtactgttttctctctgggcacctctcatttcggaaggccatcagaggcgcccactactgagcggccccggccgccgcagcagcacccggagccccagtcccggtttccccgcggtgccggagcccggagctcgccgccgcccaggcctcaggaatcgaaggggtggttgctgcttttgctacatgacttgccagcgcccgagcctgcggtccaactgcgctgctgccggagcgctcagtgccgccgctgccgcccgcgccccccgcgccccgttcggcacccaccggtcgccgcgccgcccgcgcgccgctgtcccgctcccgcgccgccgccgccgtttccccccgacgactgggtgatgctggacatgggagataggaaagaggtgaaaatgatccccaagtcctcgttcagcatcaacagcctggtgcccgagggcctccagaacgacaaccaccacgcgagccacggccaccacaacagccaccacccccagcaccaccaccaccaccaccaccatcaccaccacccgccgccgcccgccccgcaaccgccgccgccgccgcagcagcagcagccgccgccgccgccgccgccgccgctcgccccgcagacgcggggcgccgcgccgncgancgacganaagggcccccagctgcttctgctgcccgccgcaccgnccaccaccggccgccgnccggagctaaagcggaggcggctgccggccgggggagctggcgcccgtcgggccggacgagaaggagaagggcgccggcgccgggggggaggagaagaagggggcgggcgagggcggcaaggacggggaggggggcaaggagggcgagaagaagaacggcaagtacgagaagccgccgttcagctacaacgcgctcatcatgatggccatccggcagagccccgagaagcggctcacgctcaacggcatctacgagttcatcatgaagaacttcccttactaccgcgagaacaagcagggctggcagaactccatccgccacaatctgtccctcaacaagtgcttcgtgaaggtgccgcgccactacgacgacccgggcaagggcaactactggatgctggacccgtcgagcgacgacgtgttcatcggcggcaccacgggcaagctgcggcgccgctccaccacctcgcgggccaagctggccttcaagcgcggtgcgcgcctcacctccaccggcctcaccttcatggaccgcgccggctccctctactggcccatgtcgcccttcctgtccctgcaccacccccgcgccagcagcactttgagttacaacggcaccacgtcggcctaccccagccaccccatgccctacagctccgtgttgactcagaactcgctgggcaacaaccactccttctccaccgccaacgggctgagcgtggaccggctggtcaacggggagatcccgtacgccacgcaccacctcacggccgccgcgctagccgcctcggtgccctgcggcctgtcggtgccctgctctgggacctactccctcaacccctgctccgtcaacctgctcgcgggccagaccagttactttttcccccacgtcccgcacccgtcaatgacttcgcagagcagcacgtccatgagcgccagggccgcgtcctcctccacgtcgccgcaggccccctcgaccctgccctgtgagtctttaagaccctctttgccaagttttacgacgggactgtctgggggactgtctgattatttcacacatcaaaatcaggggtcttcttccaaccctttaatacattaacatccctgggaccagactgtaagtgaacgttttacacacatttgcattgtaaatgataattaaaaaaataagtccaggtattttttattaagcccccccctcccatttctgtacgtttgttcagtctctagggttgtttattattctaacaaggtgtggagtgtcagcgaggtgcaatgtggggagaatacattgtagaatataaggtttggaagtcaaattatagtagaatgtgtatctaaatagtgactgctttgccatttcattcaaacctgacaagtctatctctaagagccgccagatttccatgtgtgcagtattataagttatcatggaactatatggtggacgcagaccttgagaacaacctaaattatggggagaattttaaaatgttaaactgtaatttgtatttaaaaagcattcgtagtaaaggtgcccaagaaattattttggccatttattgttttgtccttttctttaaagaactgtttttttttcttttgtttacttttagaccaaagattgggttctagaaaatgcacttggtatactaagtattaaaacaaacaaaaaggaaagttgtttcagttggcaacactgcccattcaattgaatcagaaggggacaaaattaacgattgccttcagtttgtgttgtgtatattttgatgtatgtggtcactaacaggtcacttttattttttctaaatgtagtgaaatgttaatacctattgtacttataggtaaaccttgcaaatatgtaacctgtgttgcgcaaatgccgcataaatttgagtgattgttaatgttgtcttaaaatttcttgattgtgatactgtggtcatatgcccgtgtttgtcacttacaaaaatgtttactatgaacacacagaaataaaaaataggctaaattca

SEQ ID NO: 335130 - DNA, 3168 bp, Homo sapiens
  misc_feature (1068)..(1068): n is a, c, g, or t
  misc_feature (1072)..(1072): n is a, c, g, or t
  misc_feature (1079)..(1079): n is a, c, g, or t
  misc_feature (1116)..(1116): n is a, c, g, or t
  misc_feature (1133)..(1133): n is a, c, g, or t
cgaaccttcccagttccaaagcccaagaagctgggactgtgagatccacgttcccaaggctccccggtgctttccagcagcactcagggttggcaagagctggcttcagtatactgttatttcaggaatgaggcccgcacaaaataaaagcatttgagaaacggaaaggaaaaaaaaggagtgaaaataggaaggcttaaaaaaaaaaccggaaagaaatagacgcccacccttattttccctccaatgtcaacaagcaaaacgaaaatatttccagggtgatcgctcgcagctacccgcttccaattcggattagaagctgaggctggagcggcgaggagaaaacgacatcgagtcaccccgcgcgtgagcgacgctctggagcaggagagaaggaaaaggaagagacacacgtatatagcatgtgttacctgatttatttcgagattgtttggtactgttttctctctgggcacctctcatttcggaaggccatcagaggcgcccactactgagcggccccggccgccgcagcagcacccggagccccagtcccggtttccccgcggtgccggagcccggagctcgccgccgcccaggcctcaggaatcgaaggggtggttgctgcttttgctacatgacttgccagcgcccgagcctgcggtccaactgcgctgctgccggagcgctcagtgccgccgctgccgcccgcgccccccgcgccccgttcggcacccaccggtcgccgcgccgcccgcgcgccgctgtcccgctcccgcgccgccgccgccgtttccccccgacgactgggtgatgctggacatgggagataggaaagaggtgaaaatgatccccaagtcctcgttcagcatcaacagcctggtgcccgagggcctccagaacgacaaccaccacgcgagccacggccaccacaacagccaccacccccagcaccaccaccaccaccaccaccatcaccaccacccgccgccgcccgccccgcaaccgccgccgccgccgcagcagcagcagccgccgccgccgccgagacgcggggcgccgcgccgncgancgacganaagggcccccagctgcttctgctgcccgccgcaccgnccaccaccggccgccgnccggagctaaagcggagggctgggcggcaagggcgagccggctgccggccgggggagctggcgcccgtcgggccggacgagaaggagaagggcgccggcgccgggggggaggagaagaagggggcgggcgagggcggcaaggacggggaggggggcaaggagggcgagaagaagaacggcaagtacgagaagccgccgttcagctacaacgcgctcatcatgatggccatccggcagagccccgagaagcggctcacgctcaacggcatctacgagttcatcatgaagaacttcccttactaccgcgagaacaagcagggctggcagaactccatccgccacaatctgtccctcaacaagtgcttcgtgaaggtgccgcgccactacgacgacccgggcaagggcaactactggatgctggacccgtcgagcgacgacgtgttcatcggcggcaccacgggcaagctgcggcgccgctccaccacctcgcgggccaagctggccttcaagcgcggtgcgcgcctcacctccaccggcctcaccttcatggaccgcgccggctccctctactggcccatgtcgcccttcctgtccctgcaccacccccgcgccagcagcactttgagttacaacggcaccacgtcggcctaccccagccaccccatgccctacagctccgtgttgactcagaactcgctgggcaacaaccactccttctccaccgccaacgggctgagcgtggaccggctggtcaacggggagatcccgtacgccacgcaccacctcacggccgccgcgctagccgcctcggtgccctgcggcctgtcggtgccctgctctgggacctactccctcaacccctgctccgtcaacctgctcgcgggccagaccagttactttttcccccacgtcccgcacccgtcaatgacttcgcagagcagcacgtccatgagcgccagggccgcgtcctcctccacgtcgccgcaggccccctcgaccctgccctgtgagtctttaagaccctctttgccaagttttacgacgggactgtctgggggactgtctgattatttcacacatcaaaatcaggggtcttcttccaaccctttaatacattaacatccctgggaccagactgtaagtgaacgttttacacacatttgcattgtaaatgataattaaaaaaataagtccaggtattttttattaagcccccccctcccatttctgtacgtttgttcagtctctagggttgtttattattctaacaaggtgtggagtgtcagcgaggtgcaatgtggggagaatacattgtagaatataaggtttggaagtcaaattatagtagaatgtgtatctaaatagtgactgctttgccatttcattcaaacctgacaagtctatctctaagagccgccagatttccatgtgtgcagtattataagttatcatggaactatatggtggacgcagaccttgagaacaacctaaattatggggagaattttaaaatgttaaactgtaatttgtatttaaaaagcattcgtagtaaaggtgcccaagaaattattttggccatttattgttttgtccttttctttaaagaactgtttttttttcttttgtttacttttagaccaaagattgggttctagaaaatgcacttggtatactaagtattaaaacaaacaaaaaggaaagttgtttcagttggcaacactgcccattcaattgaatcagaaggggacaaaattaacgattgccttcagtttgtgttgtgtatattttgatgtatgtggtcactaacaggtcacttttattttttctaaatgtagtgaaatgttaatacctattgtacttataggtaaaccttgcaaatatgtaacctgtgttgcgcaaatgccgcataaatttgagtgattgttaatgttgtcttaaaatttcttgattgtgatactgtggtcatatgcccgtgtttgtcacttacaaaaatgtttactatgaacacacagaaataaaaaataggctaaattca

SEQ ID NO: 335131 - DNA, 421 bp, Homo sapiens
tgcacttggtatactaagtattaaaacaaacaaaaaggaaagttgtttcagttggcaacactgcccattcaattgaatcagaaggggacaaaattaacgattgccttcagtttgtgttgtgtatattttgatgtatgtggtcactaacaggtcacttttattttttctaaatgtagtgaaatgttaatacctattgtacttataggtaaaccttgcaaatatgtaacctgtgttgcgcaaatgccgcataaatttgagtgattgttaatgttgtcttaaaatttcttgattgtgatactgtggtcatatgcccgtgtttgtcacttacaaaaatgtttactatgaacacacagaaataaaaaataggctaaattcatatatatcttgatacttttgtctcttttattaagtagagctaatt

SEQ ID NO: 335132 - DNA, 3419 bp, Homo sapiens
  misc_feature (1068)..(1068): n is a, c, g, or t
  misc_feature (1072)..(1072): n is a, c, g, or t
  misc_feature (1079)..(1079): n is a, c, g, or t
  misc_feature (1116)..(1116): n is a, c, g, or t
  misc_feature (1133)..(1133): n is a, c, g, or t
  misc_feature (3210)..(3210): n is a, c, g, or t
  misc_feature (3224)..(3224): n is a, c, g, or t
  misc_feature (3237)..(3237): n is a, c, g, or t
  misc_feature (3239)..(3239): n is a, c, g, or t
  misc_feature (3244)..(3244): n is a, c, g, or t
  misc_feature (3254)..(3254): n is a, c, g, or t
  misc_feature (3257)..(3257): n is a, c, g, or t
  misc_feature (3261)..(3261): n is a, c, g, or t
  misc_feature (3267)..(3267): n is a, c, g, or t
  misc_feature (3271)..(3271): n is a, c, g, or t
  misc_feature (3276)..(3276): n is a, c, g, or t
  misc_feature (3278)..(3278): n is a, c, g, or t
  misc_feature (3289)..(3289): n is a, c, g, or t
  misc_feature (3291)..(3291): n is a, c, g, or t
  misc_feature (3305)..(3306): n is a, c, g, or t
cgaaccttcccagttccaaagcccaagaagctgggactgtgagatccacgttcccaaggctccccggtgctttccagcagcactcagggttggcaagagctggcttcagtatactgttatttcaggaatgaggcccgcacaaaataaaagcatttgagaaacggaaaggaaaaaaaaggagtgaaaataggaaggcttaaaaaaaaaaccggaaagaaatagacgcccacccttattttccctccaatgtcaacaagcaaaacgaaaatatttccagggtgatcgctcgcagctacccgcttccaattcggattagaagctgaggctggagcggcgaggagaaaacgacatcgagtcaccccgcgcgtgagcgacgctctggagcaggagagaaggaaaaggaagagacacacgtatatagcatgtgttacctgatttatttcgagattgtttggtactgttttctctctgggcacctctcatttcggaaggccatcagaggcgcccactactgagcggccccggccgccgcagcagcacccggagccccagtcccggtttccccgcggtgccggagcccggagctcgccgccgcccaggcctcaggaatcgaaggggtggttgctgcttttgctacatgacttgccagcgcccgagcctgcggtccaactgcgctgctgccggagcgctcagtgccgccgctgccgcccgcgccccccgcgccccgttcggcacccaccggtcgccgcgccgcccgcgcgccgctgtcccgctcccgcgccgccgccgccgtttccccccgacgactgggtgatgctggacatgggagataggaaagaggtgaaaatgatccccaagtcctcgttcagcatcaacagcctggtgcccgagggcctccagaacgacaaccaccacgcgagccacggccaccacaacagccaccacccccagcaccaccaccaccaccaccaccatcaccaccacccgccgccgcccgccccgcaaccgccgccgccgccgcagcagcagcagccgccgccgccgccgagacgcggggcgccgcgccgncgancgacganaagggcccccagctgcttctgctgcccgccgcaccgnccaccaccggccgccgnccggagctaaagcggagggctgggcggcaagggcgagccggctgccggccgggggagctggcgcccgtcgggccggacgagaaggagaagggcgccggcgccgggggggaggagaagaagggggcgggcgagggcggcaaggacggggaggggggcaaggagggcgagaagaagaacggcaagtacgagaagccgccgttcagctacaacgcgctcatcatgatggccatccggcagagccccgagaagcggctcacgctcaacggcatctacgagttcatcatgaagaacttcccttactaccgcgagaacaagcagggctggcagaactccatccgccacaatctgtccctcaacaagtgcttcgtgaaggtgccgcgccactacgacgacccgggcaagggcaactactggatgctggacccgtcgagcgacgacgtgttcatcggcggcaccacgggcaagctgcggcgccgctccaccacctcgcgggccaagctggccttcaagcgcggtgcgcgcctcacctccaccggcctcaccttcatggaccgcgccggctccctctactggcccatgtcgcccttcctgtccctgcaccacccccgcgccagcagcactttgagttacaacggcaccacgtcggcctaccccagccaccccatgccctacagctccgtgttgactcagaactcgctgggcaacaaccactccttctccaccgccaacgggctgagcgtggaccggctggtcaacggggagatcccgtacgccacgcaccacctcacggccgccgcgctagccgcctcggtgccctgcggcctgtcggtgccctgctctgggacctactccctcaacccctgctccgtcaacctgctcgcgggccagaccagttactttttcccccacgtcccgcacccgtcaatgacttcgcagagcagcacgtccatgagcgccagggccgcgtcctcctccacgtcgccgcaggccccctcgaccctgccctgtgagtctttaagaccctctttgccaagttttacgacgggactgtctgggggactgtctgattatttcacacatcaaaatcaggggtcttcttccaaccctttaatacattaacatccctgggaccagactgtaagtgaacgttttacacacatttgcattgtaaatgataattaaaaaaataagtccaggtattttttattaagcccccccctcccatttctgtacgtttgttcagtctctagggttgtttattattctaacaaggtgtggagtgtcagcgaggtgcaatgtggggagaatacattgtagaatataaggtttggaagtcaaattatagtagaatgtgtatctaaatagtgactgctttgccatttcattcaaacctgacaagtctatctctaagagccgccagatttccatgtgtgcagtattataagttatcatggaactatatggtggacgcagaccttgagaacaacctaaattatggggagaattttaaaatgttaaactgtaatttgtatttaaaaagcattcgtagtaaaggtgcccaagaaattattttggccatttattgttttgtccttttctttaaagaactgtttttttttcttttgtttacttttagaccaaagattgggttctagaaaatgcacttggtatactaagtattaaaacaaacaaaaaggaaagttgtttcagttggcaacactgcccattcaattgaatcagaaggggacaaaattaacgattgccttcagtttgtgttgtgtatattttgatgtatgtggtcactaacaggtcacttttattttttctaaatgtagtgaaatgttaatacctattgtacttataggtaaaccttgcaaatatgtaacctgtgttgcgcaaatgccgcataaatttgagtgattgttaatgttgtcttaaaatttcttgattgtgatactgtggtcatatgcccgtgtttgtcacttacaaaaatgtttactatgaacacacagaaataaaaaataggctaaattcaaaaaaaaaaaaaaaaaactcgagttttttttttttttttttnaatctgaatcgctntcactttaatcancntctgnatgaaggcancanacancgtttncctnagagnanccccattcttnancggcagggacacanngacccacaggcccagttttcgtccgagcacagtttgccataaggaccagcgggggcttcctaacagaatcttagatttaaaagtggctcaatcaggaaccttacaaggtggtt

SEQ ID NO: 335133 - DNA, 1886 bp, Homo sapiens
  misc_feature (11)..(11): n is a, c, g, or t
  misc_feature (130)..(131): n is a, c, g, or t
ctacacacgtncgcgtcatcatgactggcccatccgagcagcagcgcgccgagtaatgccggctccacgcctcaagcggacattcttacgacgttcactcagtgaacgacacgttcgccgttaccgtacnncgcagagacacccaaagacaacggaggctggggcaacaaacacctccccagtcgcagaccacaatctgtccctcaacaagtgcttcgtgaaggtgccgcgccactacgacgacccgggcaagggcaactactggatgctggacccgtcgagcgacgacgtgttcatcggcggcaccacgggcaagctgcggcgccgctccaccacctcgcgggccaagctggccttcaagcgcggtgcgcgcctcacctccaccggcctcaccttcatggaccgcgccggctccctctactggcccatgtcgcccttcctgtccctgcaccacccccgcgccagcagcactttgagttacaacggcaccacgtcggcctaccccagccaccccatgccctacagctccgtgttgactcagaactcgctgggcaacaaccactccttctccaccgccaacgggctgagcgtggaccggctggtcaacggggagatcccgtacgccacgcaccacctcacggccgccgcgctagccgcctcggtgccctgcggcctgtcggtgccctgctctgggacctactccctcaacccctgctccgtcaacctgctcgcgggccagaccagttactttttcccccacgtcccgcacccgtcaatgacttcgcagagcagcacgtccatgagcgccagggccgcgtcctcctccacgtcgccgcaggccccctcgaccctgccctgtgagtctttaagaccctctttgccaagttttacgacgggactgtctgggggactgtctgattatttcacacatcaaaatcaggggtcttcttccaaccctttaatacattaacatccctgggaccagactgtaagtgaacgttttacacacatttgcattgtaaatgataattaaaaaaataagtccaggtattttttattaagcccccccctcccatttctgtacgtttgttcagtctctagggttgtttattattctaacaaggtgtggagtgtcagcgaggtgcaatgtggggagaatacattgtagaatataaggtttggaagtcaaattatagtagaatgtgtatctaaatagtgactgctttgccatttcattcaaacctgacaagtctatctctaagagccgccagatttccatgtgtgcagtattataagttatcatggaactatatggtggacgcagaccttgagaacaacctaaattatggggagaattttaaaatgttaaactgtaatttgtatttaaaaagcattcgtagtaaaggtgcccaagaaattattttggccatttattgttttgtccttttctttaaagaactgtttttttttcttttgtttacttttagaccaaagattgggttctagaaaatgcacttggtatactaagtattaaaacaaacaaaaaggaaagttgtttcagttggcaacactgcccattcaattgaatcagaaggggacaaaattaacgattgccttcagtttgtgttgtgtatattttgatgtatgtggtcactaacaggtcacttttattttttctaaatgtagtgaaatgttaatacctattgtacttataggtaaaccttgcaaatatgtaacctgtgttgcgcaaatgccgcataaatttgagtgattgttaatgttgtcttaaaatttcttgattgtgatactgtggtcatatgcccgtgtttgtcacttacaaaaatgtttactatgaacacacagaaataaaaaataggctaaattca

SEQ ID NO: 335134 - DNA, 257 bp, Homo sapiens
tttaaaaaaaatttttttgtagagatgtgatctcaccatcttgcccaggctgatcttaaacccctggacagcaacacgttctttagtgactgatatttcctccctcctctctttctccttttcttccttcactttattctatccttccattcttttattcagttgatatttattagtcttgaggatgggtcaagattatgcggattgttttgtttgctgcaaaggtgtatcagaaaccatttcttcaagaaacctgc

SEQ ID NO: 335135 - DNA, 153 bp, Homo sapiens
gcagtaaaacatttcagaaatatttaaatcaaagaacagagaagcatttatgtaaggctatttttatacaaccaattcttagttattgatgctaatagagctatccagtggtgtgtgtctactccaaattatttacacttatatttgtagtgc

SEQ ID NO: 335136 - DNA, 369 bp, Homo sapiens
ttgggaagaagtgcatctaaatggaatttagagaaattaggggaagcatcgtggagaaagcattccaaacccagtgttaaaagacaaatgagagtcagcctggccaaagggcaaaggatggggaggaaagaatgccaggggtgggggacaactcatatgaagactcatagaacatggtacatttggggaccaacagagatttcaatgagacggaagcatggagtgccagggctgggcaaaggaaggacacatgttcagaatatattagagaagtaaacttgaggttcatgaggaaggtctttgtgcatgataggaagaggatgcatcaaagattttaaggaaagaagctacgattataatttaagcaca

SEQ ID NO: 335137 - DNA, 577 bp, Homo sapiens
  misc_feature (114)..(114): n is a, c, g, or t
taagggcgctgcaagatgcgctttgttaaacagacccttgaaggcagcatgctcgttaagagtcatcaccactccctaatctcaagtacccagggacaccaacacttcggaagnccctggggtcctctgcctaggataaccagagacctttgttcacttgtttatctgctgaccttccctccactattgtcctgtgagccctgccaaatccccctctgcgaggaacacccaagaatgatcaattaaaaaatgataattaaaaaaaagaagaaaaagaaaaaaaagaaattgaaagatgttttgaatgaaaacttacagagaaagcgtgaaggtcttcattctcttgcattcaagtcttacaaacctgagatccagaataagttattgatcatcaaaaaaaaagcaaaacacaagaagcacaaatctggcacttgagagaaaagacaacgatagcagttacatctagaggctattatggattggaggatgagaagggaactgcatgtacctcaaacaaggcgtcggtcaaacgcgaagtatggcagtacatcaagcagggatcctctagaacgccgca

SEQ ID NO: 335138 - DNA, 591 bp, Homo sapiens
ggcccgtctcagtctactgaatccgtaattgatcatcacaagatatcgcatacaagatagcacaactctggaaaaaaatccgtctctaaaaaagcaatcacaaagaagaggaaaactgtcataaagtcacctactgtaccagagtttcagcttatttgcactaatcttgatgaactcagggaattaatcacaaaaatcgagaatgaactcaaagatctggaaaacagtagaaaaaaatcggtatccaatgtccccagcatcagtagattgccaactccctctccttgccacactccagccagtgttatgctggtgctgtcatacccatcccagattactgtagcagaatgcagttgttctttagttgtgagggaaaatggtatcatcggaggcaagctgtaaaagaattacatagtacattgatacgtcttttaaatgaattgctgccatgggaaccaaagttaatgaaggctttccaaagaaacaggagccgcctgaagaaagactatgatgatttcagaagacaacctgatcatgatacatttaatagagaactatggaccactgatgaaggtgaaggagatcttggaa

SEQ ID NO: 335139 - DNA, 829 bp, Homo sapiens
tcttatggaaagggagctggcaatctgcagctgccgtggacattggatgagaaagcatgaaagaatgatttaataagcattttcaaattatgaatgaagtactataccaccactaccccagactgaaaatacataaagaaagagaagaaggtcttcattctcttgcattcaagtcttacaaacctgagatccagaataagttattgatcatcaaaaaaaaagcaaaacacaagaagcacaaatctggaaaaaaatccgtctctaaaaaagcaatcacagaagaaaaagaaaaaaaagaaattgaaagatgttttgaatgaaaacttacagagaaagcgtgaaggtcttcattctcttgcattcaagtcttacaaacctgagatccagaataagttattgatcatcaaaaaaaaagcaaaacacaagaagcacaaatctggaaaaaaatccgtctctaaaaaagcaatcacaaagaagaggaaaactgtcataaagtcacctactgtaccagagtttcagcttatttgcactaatcttgatgaactcagggaattaatcacaaaaatcgagaatgaactcaaagatctggaaaacagtagaaaaaaatcgggaaaatggtatcatcggaggcaagctgtaaaagaattacatagtacattgatacgtcttttaaatgaattgctgccatgggaaccaaagttaatgaaggctttccaaagaaacaggagccgcctgaagaaagactatgatgatttcagaagacaacctgatcatgatacatttaatagagaactatggaccactgatgaaggtgaaggagatcttggaa

SEQ ID NO: 335140 - DNA, 399 bp, Homo sapiens
agattgcatcactgcactacagcctgggggacagagcgagactctgtctcaaataaataaataaataaaactaggacagttgattgcctttttggctaaagataaatatacttaaaatttatcattttatggtaccctctgaataataatagtataatttgttaaatttctttaggcttcgggagcaggaaagaaaagaagcagaagaagctagtcaaaaggaaatagaagaatgggaaagaaaacttctagctcaagcagctccaacttgtatggagaccatgtgggaaattccagctattgggcatttcctttgtttagctcagcaaattctaaatttgccagaaatagtcttttacgaattggaacgttgtcttctgatgcctcagtgtaatgctt

SEQ ID NO: 335141 - DNA, 611 bp, Homo sapiens
taaggggattttcacattaggctggctagagaccatagtcttcagctgtagttcttatgcaagttcctgactgcgaagtcaatgttaaaggtaaggtttttttccctatgtagtctcatcttaagttgcaaatgtagattttaattaagcagtagtaatgtgacttttttgcctaatcttgcagtagattctaccgtataacacattggagatggtaatcgttcagttcatataaacataaaacagcatttgttaatatgtctgttaacaggtagttaatagtttaatgtttgcttttactggggcttgttttgattcatcatttttatttgactcactagcagccatctgttagttacaatttaactttcaaggatctgcgtaatttgttttttgttaatgaagtgctataaacagcattatgaaggttttctcttttaatcttgaaaggaaaaaaatccgtctctaaaaaagcaatcacaaagaagaggaaaactgtcataaagtcacctactgtaccagagtttcaggtaaatgtttcaactttgtctcgaaatttttcaattttttgtttcagtgttcatatcattcctcgagagtttggctgaatt

SEQ ID NO: 335142 - DNA, 2553 bp, Homo sapiens
gcggccgccaccggcggccgaaggagaggacgacgaggaggaggtggcagcggcggcccagacctcagggccggcccacggaaggagtgcctcctcgctggaggacgcggacgatcaggaggaagagatggaggcgatggtgatcggaggcggttgctgcaaggagcaggagctgacctacgagctacagcagggctaccgcatcctgggcgagttcctgcaggagaagcaccggggcctcaccgccccctttctgcagcccttggggggcgttgccaccgcggaggaggaggtggcggaagggccgcgcagcgggggccggggcggtcgcgccttcccgcagcagcccggacagggcatgtgtctgctgcagatggaagagaagttcgccagcggccagtacgggggcatcaccgagttcgtggcggacttcaggttgatgctggagacgtgctaccgcctgcacggagtggaccactggatctccaaacagggccagaagctggagatgatgctggagcagaagttagcgcttctctctcggcacttgagagaaaagacaacgatagcagttacatctagaggctattatggattggaggatgagaagggaactgcatgtacctcaacaaggcgtcggtcaacaccgcgaagtttggcaggcttgacaagtggagtttttgaatctataatggttcaagttttgagacaggaagaacagctgagagcaaaagaagaaaaaaggcttcgggagcaggaaagaaaagaagcagaagaagctagtcaaaaggaaatagaagaatgggaaagaaaacttctagctcaagcagctccaacttgtatggagaccatgtgggaaattccagctattgggcatttcctttgtttagctcagcaaattctaaatttgccagaaatagtcttttacgaattggaacgttgtcttctgatgcctcagtgtaatgcttttctatcgaaaataatgacttctctattaagtcctccccatcgcagacctaccttacatcgaagacctactttgccttataggacctgggaagcagcgctgaggcagaaagtacaacagtggtacactgctgtagggcaaactgaaaatcctgataactgtgctgaaaaactggggttgtgtcctcagttttttaaagttcttggagaagttaatccattggaagaaaaaccttttcacgaactacctttttaccaaaaagtgtggctacttaagggtctttgtgactttgtgtatgaaacacaaaaggaagttcaagatgctgtacttggacagcctatccatgaatgcagggaagttattcttgggttatgattatttggagaatgcttatgtacattttccacagttctgtggtgcagatgtacggatttataaacagagaccctttcaggccccagaatttccaattccacccattaaaatacaaagagtacctcggattaaattggagaaattgaagtgtgactatgttagtacaagtaatggagaacatagatgtagcagagatagcctgccctcttccttcaagaaagagcaggaaaataattttgatccagcttgctgtcctgctaaaatgatcttggataatcatgacatctctgttgaaatgggagtaaaatccaactatgaaattagaattcgcaggccttgtgaaattaaaaaaactgattgttgtaaagaaaatttagagaaaccaaggagtccaggggaagttactggctttggagagcctctcagtccaggtgaaataaggtttatagaaaatcaggaaaaatacggtgaagcttccagaataaagattgaacccagtccattaaaagaaaatactctaaaatcttgccaaatacatgtaaatggaagtcacagtgatcatccagaaattaactgccacaaagttgtaagggatattctattagagcagtcactacagagccacaagaaactcaaactaactaaaatgagggcaaaaaagaagaaaaagaaaaaaaagaaattgaaagatgttttgaatgaaaacttacagagaaagcgtgaaggtcttcattctcttgcattcaagtcttacaaacctgagatccagaataagttattgatcatcaaaaaaaaagcaaaacacaagaagcacaaatctggaaaaaaatccgtctctaaaaaagcaatcacaaagaagaggaaaactgtcataaagtcacctactgtaccagagtttcagcttatttgcactaatcttgatgaactcagggaattaatcacaaaaatcgagaatgaactcaaagatctggaaaacagtagaaaaaaatcgggaaaatggtatcatcggaggcaagctgtaaaagaattacatagtacattgatacgtcttttaaatgaattgctgccatgggaaccaaagttaatgaaggctttccaaagaaacaggagccgcctgaagaaagactatgatgatttcagaagacaacctgatcatgatacatttaatagagaactatggaccactgatgaaggtgaaggagatcttggaa

SEQ ID NO: 335143 - DNA, 298 bp, Homo sapiens
aacccagtccattaaaagaaaatactctaaaatcttgccaaatacatgtaaatggaagtcacagtgatcatccagaaattaactgccacaaagttgtaagggatattctattagagcagtcactacagagccacaagaaactcaaactaactaaaatgagggcaaaaaagaagaaaaagaaaaaaaagaaattgaaagatgttttgaatgaaaacttacagagaaagcgtgaaggtcttcattctcttgcattcaagtcttacaaacctgagatccagaataagttattgatcatcaa

SEQ ID NO: 335144 - DNA, 1529 bp, Homo sapiens
agcggaggtgagctgccacgtccggaggagggcagcaagaatgaaagacctctagttttccagactcccggagccctggtctctacaccacatggacgttatccacctcctctgtgtcctcccaaggcagcatttcagaaggtgatccacggcaaagccgtcccttcaaatccgtctttgtgcccactgccatagtcaaccccgtgagaagcacagccggccctgggactttaggacaagggtctcttcggaaagggcggagcagcatgagaaagagtaagtggtggcagagagatggatccctgcagagacccctccagtccgggatccccactctcgtggtaggctccctcagacgcagccccaccatggtccttcggcctcagcagttccaattctaccagccacaggggatcccctcctccccctcagccgtggtggtggagatggggtccaagcctgccctcacgggggagcccgccctcacgtgcatcagcaggggcagtgaggcccggatccactccgcggccagctccctcattatggaagacaaagaaatccccatcaagagtgagcctctgccaaaaccgcccgcatctgccccaccatccatcctggtgaaaccagaaaactcaagaaatggcatcgaaaagcaagtcaaaaccgtgagatttcagaattacagccctcctcccaccaaacattacacctcccatcccacctccggaaagcctgaacagccagccaccctcaaggcgtcccagcctgaagcagcgtccttgggcccagagatgaccgtcctatttgcccaccgaagtggctgccactccggacagcagacagacctccggagaaagtcagctcttgccaaggccacaaccctggtgtccactgcctcaggcacgcagaccgtgtttcccagcaaatgaacctacgggtggcttttcctagaccccaaagaggtgaattgcatttaaatacagtctgcctccactgagggcatcctgccattctttggggacttgagcatgggtccttgttcttcctatttcacctccaggaaagcaaaagtgggagcagaaattcctgccctgggtgggaggatagatggcgtggccttccaaacatacaaacataatgatttgatgccacaaagctcgcttactcagaccaaggagtgaaaaattgtcgtgcccactttatgccccagcatggagtatgtggcctcttgtcatccccgtgttactgtgtagaatttctatggtgtcctaaagggggctgcagcaggggtgtgacaacggtgggattgttggcgttgcttctttgaccttacaatatcctcaacaagcattagaacaacttctgccatcttctggggcctgtacactggccactagtagctgccatatctttttccctctgtaaagtcataatcctggctgcaaagggaggatttctgcgcggggtgtgaggtggatactttgaacattctgagaacccaataaaactagaaggagccagcttcctga

SEQ ID NO: 335145 - DNA, 2991 bp, Homo sapiens
ttggagggcgcagcgcacccctgctgcgcggaggagggggctgagctgaactcagcagaagttacatgcacaagcaggcaaaaattctgacgttctcaagagaccagctctgcccccgtggctcaactgaccctaccatgtggacgctgctcctccaggtgggaactggagttttgaaataaaatggatgatttgacgttacttgatcttctggagtgccctgtgtgctttgagaagctcgatgtcacagccaaagtcctcccttgccagcacaccttctgcaaaccatgtctacagagggttttcaaggcccacaaagagctgcggtgccccgaatgcaggacgcctgtgttttccaacattgaggcgctgccggccaacctgctgctcgtgcgccttctggatggagtgcgctcagggcagagctccgggagagggggctccttccgcaggcctggcacgatgaccttgcaggatggcaggaaaagcaggaccaaccccagacgtctgcaggccagtcctttccggctagtgcctaatgtcagaatccacatggatggggtgcctcgagcaaaggccttatgcaactacagagggcagaatcccggtgacctaaggtttaataagggagatatcatccttctccggagacagcttgatgagaattggtaccagggggaaatcaatggcatcagcgggaacttcccagccagctccgtggaagtcatcaagcagctgccccagccgcccccgctctgcagggccctctacaacttcgacctacgaggcaaggacaagagtgagaaccaggattgcctgaccttcctcaaggacgatatcatcactgtgatcagccgagtggatgagaactgggcagaaggcaagttaggagataaagtaggcatcttccctatcttgtttgtagagccaaacctcaccgcaagacaccttttagagaagaacaaaggtcgccagtcatcctgcacaaaaaacctgtccctggtgtcctcgtcctccagaggcaacacgtctaccctccgtaggggcccagggtccaggaggaaggtgcctgggcagttttccatcacaacagccttgaacactctcaaccggatggtccattctccttcagggcgccatatggtagagatcagcaccccagtgctcatcagctccagcaacccctctgtgatcacccagcccatggagaaagcagacgttccttccagctgtgtgggacaggtcagcacttatcaccccgcacctgtctctccaggacattccacagccgtggtcagtctgcctggctcccagcaacacctctcagcgaacatgtttgtagccctgcactcctactcagcccatggacccgatgagctggacctgcaaaagggagaaggcgtcagggtcctggggaagtgccaggacggctggctcaggggcgtctccttggtcaccgggcgagtcggcatcttcccaaacaattacgtcatccccattttcagaaagacctctagttttccagactcccggagccctggtctctacaccacatggacgttatccacctcctctgtgtcctcccaaggcagcatttcagaaggtgatccacggcaaagccgtcccttcaaatccgtctttgtgcccactgccatagtcaaccccgtgagaagcacagccggccctgggactttaggacaagggtctcttcggaaagggcggagcagcatgagaaagagtaagtggtggcagagagatggatccctgcagagacccctccagtccgggatccccactctcgtggtaggctccctcagacgcagccccaccatggtccttcggcctcagcagttccaattctaccagccacaggggatcccctcctccccctcagccgtggtggtggagatggggtccaagcctgccctcacgggggagcccgccctcacgtgcatcagcaggggcagtgaggcccggatccactccgcggccagctccctcattatggaagacaaagaaatccccatcaagagtgagcctctgccaaaaccgcccgcatctgccccaccatccatcctggtgaaaccagaaaactcaagaaatggcatcgaaaagcaagtcaaaaccgtgagatttcagaattacagccctcctcccaccaaacattacacctcccatcccacctccggaaagcctgaacagccagccaccctcaaggcgtcccagcctgaagcagcgtccttgggcccagagatgaccgtcctatttgcccaccgaagtggctgccactccggacagcagacagacctccggagaaagtcagctcttgccaaggccacaaccctggtgtccactgcctcaggcacgcagaccgtgtttcccagcaaatgaacctacgggtggcttttcctagaccccaaagaggtgaattgcatttaaatacagtctgcctccactgagggcatcctgccattctttggggacttgagcatgggtccttgttcttcctatttcacctccaggaaagcaaaagtgggagcagaaattcctgccctgggtgggaggatagatggcgtggccttccaaacatacaaacataatgatttgatgccacaaagctcgcttactcagaccaaggagtgaaaaattgtcgtgcccactttatgccccagcatggagtatgtggcctcttgtcatccccgtgttactgtgtagaatttctatggtgtcctaaagggggctgcagcaggggtgtgacaacggtgggattgttggcgttgcttctttgaccttacaatatcctcaacaagcattagaacaacttctgccatcttctggggcctgtacactggccactagtagctgccatatctttttccctctgtaaagtcataatcctggctgcaaagggaggatttctgcgcggggtgtgaggtggatactttgaacattctgagaacccaataaaactagaaggagccagcttcctga

SEQ ID NO: 335146 - DNA, 1708 bp, Homo sapiens
ttggagggcgcagcgcacccctgctgcgcggaggagggggctgagctgaactcagcagaagttacatgcacaagcaggcaaaaattctgacgttctcaagagaccagctctgcccccgtggctcaactgaccctaccatgtggacgctgctcctccaggtgggaactggagttttgaaataaaatggatgatttgacgttacttgatcttctggagtgccctgtgtgctttgagaagctcgatgtcacagccaaagtcctcccttgccagcacaccttctgcaaaccatgtctacagagggttttcaaggcccacaaagagctgcggtgccccgaatgcaggacgcctgtgttttccaacattgaggcgctgccggccaacctgctgctcgtgcgccttctggatggagtgcgctcagggcagagctccgggagagggggctccttccgcaggcctggcacgatgaccttgcaggatggcaggaaaagcaggaccaaccccagacgtctgcaggccagtcctttccggctagtgcctaatgtcagaatccacatggatggggtgcctcgagcaaaggccttatgcaactacagagggcagaatcccggtgacctaaggtttaataagggagatatcatccttctccggagacagcttgatgagaattggtaccagggggaaatcaatggcatcagcgggaacttcccagccagctccgtggaagtcatcaagcagctgccccagccgcccccgctctgcagggccctctacaacttcgacctacgaggcaaggacaagagtgagaaccaggattgcctgaccttcctcaaggacgatatcatcactgtgatcagccgagtggatgagaactgggcagaaggcaagttaggagataaagtaggcatcttccctatcttgtttgtagagccaaacctcaccgcaagacaccttttagagaagaacaaaggtcgccagtcatcctgcacaaaaaacctgtccctggtgtcctcgtcctccagaggcaacacgtctaccctccgtaggggcccagggtccaggaggaaggtgcctgggcagttttccatcacaacagccttgaacactctcaaccggatggtccattctccttcagggcgccatatggtagagatcagcaccccagtgctcatcagctccagcaacccctctgtgatcacccagcccatggagaaagcagacgttccttccagctgtgtgggacaggtcagcacttatcaccccgcacctgtctctccaggacattccacagccgtggtcagtctgcctggctcccagcaacacctctcagcgaacatgtttgtagccctgcactcctactcagcccatggacccgatgagctggacctgcaaaagggagaaggcgtcagggtcctggggaagtgccaggacggctggctcaggggcgtctccttggtcaccgggcgagtcggcatcttcccaaacaattacgtcatccccattttcagaaagacctctagttttccagactcccggagccctggtctctacaccacatggacgttatccacctcctctgtgtctgccatatctttttccctctgtaaagtcataatcctggctgcaaagggaggatttctgcgcggggtgtgaggtggatactttgaacattctgagaacccaataaaactagaaggagccagcttcctga

SEQ ID NO: 335147 - DNA, 1891 bp, Homo sapiens
ttggagggcgcagcgcacccctgctgcgcggaggagggggctgagctgaactcagcagaagttacatgcacaagcaggcaaaaattctgacgttctcaagagaccagctctgcccccgtggctcaactgaccctaccatgtggacgctgctcctccaggtgggaactggagttttgaaataaaatggatgatttgacgttacttgatcttctggagtgccctgtgtgctttgagaagctcgatgtcacagccaaagtcctcccttgccagcacaccttctgcaaaccatgtctacagagggttttcaaggcccacaaagagctgcggtgccccgaatgcaggacgcctgtgttttccaacattgaggcgctgccggccaacctgctgctcgtgcgccttctggatggagtgcgctcagggcagagctccgggagagggggctccttccgcaggcctggcacgatgaccttgcaggatggcaggaaaagcaggaccaaccccagacgtctgcaggccagtcctttccggctagtgcctaatgtcagaatccacatggatggggtgcctcgagcaaaggccttatgcaactacagagggcagaatcccggtgacctaaggtttaataagggagatatcatccttctccggagacagcttgatgagaattggtaccagggggaaatcaatggcatcagcgggaacttcccagccagctccgtggaagtcatcaagcagctgccccagccgcccccgctctgcagggccctctacaacttcgacctacgaggcaaggacaagagtgagaaccaggattgcctgaccttcctcaaggacgatatcatcactgtgatcagccgagtggatgagaactgggcagaaggcaagttaggagataaagtaggcatcttccctatcttgtttgtagagccaaacctcaccgcaagacaccttttagagaagaacaaaggtcgccagtcatcctgcacaaaaaacctgtccctggtgtcctcgtcctccagaggcaacacgtctaccctccgtaggggcccagggtccaggaggaaggtgcctgggcagttttccatcacaacagccttgaacactctcaaccggatggtccattctccttcagggcgccatatggtagagatcagcaccccagtgctcatcagctccagcaacccctctgtgatcacccagcccatggagaaagcagacgttccttccagctgtgtgggacaggtcagcacttatcaccccgcacctgtctctccaggacattccacagccgtggtcagtctgcctggctcccagcaacacctctcagcgaacatgtttgtagccctgcactcctactcagcccatggacccgatgagctggacctgcaaaagggagaaggcgtcagggtcctggggaagtgccaggacggctggctcaggggcgtctccttggtcaccgggcgagtcggcatcttcccaaacaattacgtcatccccattttcagaaagacctctagttttccagactcccggagccctggtctctacaccacatggacgttatccacctcctctgtgtcctcccaaggcagcatttcagaaggtgatccacggcaaagccgtcccttcaaatccgtctttgtgcccactgccatagtcaaccccgtgagaagcacagccggccctgggactttaggacaagggtctcttcggaaagggcggagcagcatgagaaagagtaagtggtggcagagaggtacgtgcctagagctaagtgatggggggaatctgacccaggggtacacaggatgctttttgcaaaaacaggatcttggctttaaactaagcccctgcaaagggtattatacaattcccaaatgatgagttttat

SEQ ID NO: 335148 - DNA, 1104 bp, Homo sapiens
ttggagggcgcagcgcacccctgctgcgcggaggagggggctgagctgaactcagcagaagttacatgcacaagcaggcaaaaattctgacgttctcaagagaccagctctgcccccgtggctcaactgaccctaccatgtggacgctgctcctccaggtgggaactggagttttgaaataaaatggatgatttgacgttacttgatcttctggagtgccctgtgtgctttgagaagctcgatgtcacagccaaagtcctcccttgccagcacaccttctgcaaaccatgtctacagagggttttcaaggcccacaaagagctgcggtgccccgaatgcaggacgcctgtgttttccaacattgaggcgctgccggccaacctgctgctcgtgcgccttctggatggagtgcgctcagggcagagctccgggagagggggctccttccgcaggcctggcacgatgaccttgcaggatggcaggaaaagcaggaccaaccccagacgtctgcaggccagtcctttccggctagtgcctaatgtcagaatccacatggatggggtgcctcgagcaaaggccttatgcaactacagagggcagaatcccggtgacctaaggtttaataagggagatatcatccttctccggagacagcttgatgagaattggtaccagggggaaatcaatggcatcagcgggaacttcccagccagctccgtggaagtcatcaagcagctgccccagccgcccccgctctgcagggccctctacaacttcgacctacgaggcaaggacaagagtgagaaccaggattgcctgaccttcctcaaggacgatatcatcactgtgatcagccgagtggatgagaactgggcagaaggcaagttaggagataaagtaggcatcttccctatcttgtttgtagagccaaacctcaccgcaagacaccttttagagaagaacaaaggtcgccagtcatcctgcacaaaaaacctgtccctggtgtcctcgtcctccagaggcaacacgtctaccctctataacttcgacctacgacgcaagaacaagagtgaacaggattgctctgacctttcctcaaggagc

SEQ ID NO: 335149 - DNA, 1348 bp, Homo sapiens
agcggaggtgagctgccacgtccggaggagggcagcaagaatgaaagacctctagttttccagactcccggagccctggtctctacaccacatggacgttatccacctcctctgtgtcctcccaaggcagcatttcagaaggtgatccacggcaaagccgtcccttcaaatccgtctttgtgcccactgccatagtcaaccccgtgagaagcacagccggccctgggactttaggacaagggtctcttcggaaagggcggagcagcatgagaaagagtaagtggtggcagagagatggatccctgcagagacccctccagtccgggatccccactctcgtggtaggctccctcagacgcagccccaccatggtccttcggcctcagcagttccaattctaccagccacaggggatcccctcctccccctcagccgtggtggtggagatggggtccaagcctgccctcacgggggagcccgccctcacgtgcatcagcaggggcagtgaggcccggatccactccgcggccagctccctcattatggaagacaaagaaatccccatcaagagtgagcctctgccaaaaccgcccgcatctgccccaccatccatcctggtgaaaccagaaaactcaagaaatggcatcgaaaagcaagtcaaaaccgtgagatttcagaattacagccctcctcccaccaaacattacacctcccatcccacctccggaaagcctgaacagccagccaccctcaaggcgtcccagcctgaagcagcgtccttgggcccagagatgaccgtcctatttgcccaccgaagtggctgccactccggacagcagacagacctccggagaaagtcagctcttgccaaggccacaaccctggtgtccactgcctcaggcacgcagaccgtgtttcccagcaaatgaacctacgggtggcttttcctagaccccaaagaggtgaattgcatttaaatacagtctgcctccactgagggcatcctgccattctttggggacttgaaaaaaaaaaaaaaaaaaaaaacaaaaaaaaaaaaaaaaaaaaaaaaaaaaaaaaaaaaaaaaaaaaaaaaaaaaaaaaaagggggggggcaccaacaaaaacctcccaggaggggacacaacacaaaccgagacgaccacttatcgaggaaaaaggggggcccaaaaaagggggggcacaatatacacggggcgcgggcgcgccgggcaaaaaccacagacacggagagggggagcaaacgcggcccacgcgagcgacccagggcgacagaggaaccaccaccctcaggggggcgaccacacagggggcccacacccccgca

SEQ ID NO: 335150 - DNA, 1370 bp, Homo sapiens
gagagaatgtgagtgcagtcagattaggaaagcgcttgtctattctgggatatcaggaagcactgcttacccagccccacccaacctactgccagccgcccctgctgctgatctctctgtcctataattccccagatggatccctgcagagacccctccagtccgggatccccactctcgtggtaggctccctcagacgcagccccaccatggtccttcggcctcagcagttccaattctaccagccacaggggatcccctcctccccctcagccgtggtggtggagatggggtccaagcctgccctcacgggggagcccgccctcacgtgcatcagcaggggcagtgaggcccggatccactccgcggccagctccctcattatggaagacaaagaaatccccatcaagagtgagcctctgccaaaaccgcccgcatctgccccaccatccatcctggtgaaaccagaaaactcaagaaatggcatcgaaaagcaagtcaaaaccgtgagatttcagaattacagccctcctcccaccaaacattacacctcccatcccacctccggaaagcctgaacagccagccaccctcaaggcgtcccagcctgaagcagcgtccttgggcccagagatgaccgtcctatttgcccaccgaagtggctgccactccggacagcagacagacctccggagaaagtcagctcttgccaaggccacaaccctggtgtccactgcctcaggcacgcagaccgtgtttcccagcaaatgaacctacgggtggcttttcctagaccccaaagaggtgaattgcatttaaatacagtctgcctccactgagggcatcctgccattctttggggacttgagcatgggtccttgttcttcctatttcacctccaggaaagcaaaagtgggagcagaaattcctgccctgggtgggaggatagatggcgtggccttccaaacatacaaacataatgatttgatgccacaaagctcgcttactcagaccaaggagtgaaaaattgtcgtgcccactttatgccccagcatggagtatgtggcctcttgtcatccccgtgttactgtgtagaatttctatggtgtcctaaagggggctgcagcaggggtgtgacaacggtgggattgttggcgttgcttctttgaccttacaatatcctcaacaagcattagaacaacttctgccatcttctggggcctgtacactggccactagtagctgccatatctttttccctctgtaaagtcataatcctggctgcaaagggaggatttctgcgcggggtgtgaggtggatactttgaacattctgagaacccaataaaactagaaggagccagcttcctga

SEQ ID NO: 335151 - DNA, 1461 bp, Homo sapiens
  misc_feature (1343)..(1343): n is a, c, g, or t
  misc_feature (1358)..(1358): n is a, c, g, or t
  misc_feature (1394)..(1394): n is a, c, g, or t
  misc_feature (1403)..(1403): n is a, c, g, or t
  misc_feature (1418)..(1418): n is a, c, g, or t
  misc_feature (1426)..(1426): n is a, c, g, or t
  misc_feature (1442)..(1442): n is a, c, g, or t
ttggagggcgcagcgcacccctgctgcgcggaggagggggctgagctgaactcagcagaagttacatgcacaagcaggcaaaaattctgacgttctcaagagaccagctctgcccccgtggctcaactgaccctaccatgtggacgctgctcctccaggtgggaactggagttttgaaataaaatggatgatttgacgttacttgatcttctggagtgccctgtgtgctttgagaagctcgatgtcacagccaaagtcctcccttgccagcacaccttctgcaaaccatgtctacagagggttttcaaggcccacaaagagctgcggtgccccgaatgcaggacgcctgtgttttccaacattgaggcgctgccggccaacctgctgctcgtgcgccttctggatggagtgcgctcagggcagagctccgggagagggggctccttccgcaggcctggcacgatgaccttgcaggatggcaggaaaagcaggaccaaccccagacgtctgcaggccagtcctttccggctagtgcctaatgtcagaatccacatggatggggtgcctcgagcaaaggccttatgcaactacagagggcagaatcccggtgacctaaggtttaataagggagatatcatccttctccggagacagcttgatgagaattggtaccagggggaaatcaatggcatcagcgggaacttcccagccagctccgtggaagtcatcaagcagctgccccagccgcccccgctctgcagggccctctacaacttcgacctacgaggcaaggacaagagtgagaaccaggattgcctgaccttcctcaaggacgatatcatcactgtgatcagccgagtggatgagaactgggcagaaggcaagttaggagataaagtaggcatcttccctatcttgtttgtagagccaaacctcaccgcaagacaccttttagagaagaacaaaggtcgccagtcatcctgcacaaaaaacctgtccctggtgtcctcgtcctccagaggcaacacgtctaccctccgtaggggcccagggtccaggaggaaggtgcctgggcagttttccatcacaacagccttgaacactctcaaccggatggtccattctccttcagggcgccatatggtagagatcagcaccccagtgctcatcagctccagcaacccctctgtgatcacccagcccatggagaaagcagacgttccttccagctgtgtgggacaggtcagcacttatcaccccgcacctgtctctccaggacattccacagccgtggtcagtctgcctggctcccagcaacacctctcagcgaacatgtttgtccntgcctctactcaggnccacacatcacttgctcactagacaccatccactcntcctggacntattccacagctctnccctctgntctctctctcatctcnaaccgttaattgtaccacc

SEQ ID NO: 335152 - DNA, 167 bp, Homo sapiens
agcaaagctgtttcctccctggggaggggacagtactgatttccgcctttggagggaggggtttgctggtttacctgcagctgaactttggaaggctttgagcacaaagaatccagatcctggaaaatccccagacccagagcaggcctgctcgtgcccagccccag

SEQ ID NO: 335153 - DNA, 432 bp, Homo sapiens
aaacccaaatgtgacagtatttggaggtgaggcctttggaggtgaatagatgaatgagatgagtgtcctcataaagaaacccccaagagctgccttgcccctcccgctgtgtgaggttagagtgaaaagatggccacctatgaggaatgggccttcaccagacactgaatctgctggcaccttgatcttggacttccccacctccagaactgtgagaaagaaattctgtttataagccacacagactgtgttatttcattacagcagcctgaaggactaaaacactgtaaaagtgaggttccagaaggagagaataaaaagtatagaggagaggcaatattcgaaaagatgatttcacatgatttttaagaattagtgaaagacgtaaatccaaagatacaggaagcataacaagcatggggtaaaaaaaaa

SEQ ID NO: 335154 - DNA, 6909 bp, Homo sapiens
gcccgggcaggtggttgcagcattgcagaagagaaaagtagtttgttggcagagaatcaggtattaatggaaagactcaatcaatctgattctatagaagaccctaacagtccagcaggaagaaggcatttgcagctccagactcaattagaacagctccaagaagaaacattcagactagaagcagccaaagatgattatcgaatacgttgtgaagagttagaaaaggagatctctgaacttcggcaacagaatgatgaactgaccactttggcagatgaagctcagtctctgaaagatgagatcgacgtgctgagacattcttctgataaagtatctaaactagaaggtcaagtatcactagaattcagcggccgctgaattctagggaggcgcgccccccggctgggcgccgcgcgcaccatggggctcccagcgctcgagttcagcgactgctgcctcgatagtccgcacttccgagagacgctcaagtcgcacgaagcagagctggacaagaccaacaaattcatcaaggagctcatcaaggacgggaagtcactcataagcgcgctcaagaatttgtcttcagcgaagcggaagtttgcagattccttaaatgaatttaaatttcagtgcataggagatgcagaaacagatgatgagatgtgtatagcaaggtctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaaatatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggggtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcaggtctgttgcagggtttgtttggttttctgttgctgccgttgttctctcattggctcggtcctctcttcatgcagtgttcagcctcctcgtcaactttgttccctgccatccaaacctgcacttgctttttgacaggccagaagaagcggtacatgaagactccagcacaccgttccggaaggcaaaagccttgtatgcctgcaaagctgaacatgactcagaactttcgttcacagcaggcacggtcttcgataatgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttactttttttttttgaaaagataaacttgtaaatagagtgatttgaaatactatatggcaaagttttatatttgatattctttaagttagttgctcacacacttaggctttgattgctgaagaagtatgtttaagagggagagaggggaggcaaagctgaagagagtcaaggtcactgtccccgcttcggcctgaaggaaagagaagacatttctatggccttgctctctgctgtcctgttggtgggcacgacacatcagtggtgttcagtctttatgtgtttttaagcatcccttgggctttggatttggagatgggaagagcatctccaggcaatgagtttttcaaagaatgcctacttagtagtaagatgaagctcaggatttaaataagtggggtcaggcattcgagtttttgtctttcttctcaggtgtatttcttggtacccccaagatatcaggccagaaagagatgagtcagttgctgtgctctttacttctttttctccacatcttctgaggctttagaaatgtggacaagctagttttcaaattttgtgtgcgtctgtaagttcttaaagaaccagcttcttagaatgttcagttctcaatgtgctgctgctttcccttctcctaaacattttaaaactcttccctttcacctccaattcccgtgatcccaaaagaagaggaagactccaggaggggtatagattgtgccgtcatagctttacaggtggttttaaagttagcaggggtttgtcatggtgattcactactcagtttatcagctcaaggattatacagctcttttccgggaactcacccaggagcaagcgagacactaccattgaatcagggaatgagaattaagaatggacaggaccaagacagaactcaagaaagccactggggaaaactcgagaagaaagggagtatactagtaggttagatctgtgaacctgaggacaagaagaccttgggaaatggaggcctcaggggatgtgcattcacatactattacgcttctcaaagagagaccaacatcatgcttttaacacatttgatgaggttttttatttgtgtttttgtttgttttttgagatggagtctcactctgtggcccaggctggagtgcagtggcgcggtcttggctcactgcaacctccgcctcccgggttcaagtgattctcctgtctcagcctcccaagtagctgggactgcaggcatgagccatcacacccggctggttttttgtgtttttagtagagatggggttttgccatgtttgccgggctgatctcgaactcctgacctcaagtgatctgcccacttcggacccccaaagtgctgggattccaggtgtgagccgctgcggccgaccacatttgatgtttgaagttgtaatctgtcccatcataaacttacctggagctcatgtggaggaacagaaggccaagatccttgctttgggggtgcctcacgaagcatccctgtagacacttggccccagcttcactgcttggaagcatgtccctccctcttgagttggctctgatttgaaatcgggagaaacagagctgctgccaatgggatcttttaggtaactccctccctagcttccgtgtgtctgtgcagtgcccatgagctgctgccaatgggatctttcaggtaccccctccccagcttccctgtggctgtgcggtgcccttgacagatggcttctctgtttccctttgcccagccaggctcccctccttcctattagctacaaaactggataaacttcagaatatgagccaatgagtaggaaggaacttgaagactaaagattttactctctcccctatccatgccccctacctctgactctctctgtgtgaacaggaaactttagggtagatgaggagaatgaattggttatcagagtggaagaccatggcccaggatccctgagctttcccagtagcctccagtttcctttgtaagacccagggatcacttagccatagcctgaatcttttaggggtattaaggtcagcctctcactcttccttcaggttactaacaaaatttcgtagctaaagaatgccatggccgggtgcagtggctcacgcctataatcccagcactttgggaggccgaggcgggcggatcacgaggtcaggagattgagaccatcctggctacgacggtgaagccccgtctctgctaagagtgcaaaaaattagccgggtgtggtggcgggcgcctgtagtcccagctactctggaggctgaggcaggagaatggcatgagcccgggaggcggagattgcggtgagccaagatcgcgcccctgcactccagcctgggtgacagagccagactccgtctcaaaggaaa

SEQ ID NO: 335155 - DNA, 3772 bp, Homo sapiens
  misc_feature (9)..(9): n is a, c, g, or t
gcaactatnagaggtagcgaggcctgggtggtggagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactcacaccgttccggaaggcaaaagccttgtatgcctgcaaagctgaacatgactcagaactttcgttcacagcaggcacggtcttcgataatgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttactttttttttttgaaaagataaacttgtaaatagagtgatttgaaatactatatggcaaagttttatatttgatattctttaagttagttgctcacacacttaggctttgattgctgaagaagtatgtttaagagggagagaggggaggcaaagctgaagagagtcaaggtcactgtccccgcttcggcctgaaggaaagagaagacatttctatggccttgctctctgctgtcctgttggtgggcacgacacatcagtggtgttcagtctttatgtgtttttaagcatcccttgggctttggatttggagatgggaagagcatctccaggcaatgagtttttcaaagaatgcctacttagtagtaagatgaagctcaggatttaaataagtggggtcaggcattcgagtttttgtctttcttctcaggtgtatttcttggtacccccaagatatcaggccagaaagagatgagtcagttgctgtgctctttacttctttttctccacatcttctgaggctttagaaatgtggacaagctagttttcaaattttgtgtgcgtctgtaagttcttaaagaaccagcttcttagaatgttcagttctcaatgtgctgctgctttcccttctcctaaacattttaaaactcttccctttcacctccaattcccgtgatcccaaaagaagaggaagactccaggaggggtatagattgtgccgtcatagctttacaggtggttttaaagttagcaggggtttgtcatggtgattcactactcagtttatcagctcaaggattatacagctcttttccgggaactcacccaggagcaagcgagacactaccattgaatcagggaatgagaattaagaatggacaggaccaagacagaactcaagaaagccactggggaaaactcgagaagaaagggagtatactagtaggttagatctgtgaacctgaggacaagaagaccttgggaaatggaggcctcaggggatgtgcattcacatactattacgcttctcaaagagagaccaacatcatgcttttaacacatttgatgaggttttttatttgtgtttttgtttgttttttgagatggagtctcactctgtggcccctgcactccagcctgggtgacagagccagactccgtctcaaaggaaa

SEQ ID NO: 335156 - DNA, 3842 bp, Homo sapiens
gaattagcctatcgaatggatatgtgatatccgtgcatctctcatacaatagagcatgcacgcatgcaggctttgtcctgttctgcgttttacaacctcattgctgaaattgctctgtgtgctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactcacaccgttccggaaggcaaaagccttgtatgcctgcaaagctgaacatgactcagaactttcgttcacagcaggcacggtcttcgataatgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttactttttttttttgaaaagataaacttgtaaatagagtgatttgaaatactatatggcaaagttttatatttgatattctttaagttagttgctcacacacttaggctttgattgctgaagaagtatgtttaagagggagagaggggaggcaaagctgaagagagtcaaggtcactgtccccgcttcggcctgaaggaaagagaagacatttctatggccttgctctctgctgtcctgttggtgggcacgacacatcagtggtgttcagtctttatgtgtttttaagcatcccttgggctttggatttggagatgggaagagcatctccaggcaatgagtttttcaaagaatgcctacttagtagtaagatgaagctcaggatttaaataagtggggtcaggcattcgagtttttgtctttcttctcaggtgtatttcttggtacccccaagatatcaggccagaaagagatgagtcagttgctgtgctctttacttctttttctccacatcttctgaggctttagaaatgtggacaagctagttttcaaattttgtgtgcgtctgtaagttcttaaagaaccagcttcttagaatgttcagttctcaatgtgctgctgctttcccttctcctaaacattttaaaactcttccctttcacctccaattcccgtgatcccaaaagaagaggaagactccaggaggggtatagattgtgccgtcatagctttacaggtggttttaaagttagcaggggtttgtcatggtgattcactactcagtttatcagctcaaggattatacagctcttttccgggaactcacccaggagcaagcgagacactaccattgaatcagggaatgagaattaagaatggacaggaccaagacagaactcaagaaagccactggggaaaactcgagaagaaagggagtatactagtaggttagatctgtgaacctgaggacaagaagaccttgggaaatggaggcctcaggggatgtgcattcacatactattacgcttctcaaagagagaccaacatcatgcttttaacacatttgatgaggttttttatttgtgtttttgtttgttttttgagatggagtctcactctgtggcccctgcactccagcctgggtgacagagccagactccgtctcaaaggaaa

SEQ ID NO: 335157 - DNA, 3714 bp, Homo sapiens
  misc_feature (11)..(11): n is a, c, g, or t
  misc_feature (17)..(17): n is a, c, g, or t
  misc_feature (19)..(19): n is a, c, g, or t
ctattaggatncccacncnattggcctcgacctgctgagcccaagcgatcctcccgcttcggcactccccctcctccaagtagctgggactacagacacgctccatcaaacctaggtagtttttgtatattttgtagagacaaggttttgccatgttgcccaggctgttcttaaactcctgggctaaagcaattcacctgcctcagcctcccaaggtactggcattacaggcgtgaaccaccaggcccagcctctagaagctggatatctttaaagagtagttcttagcagtcttccatgggcactgcactgagtacatagttgatactgggcaggtgggtgggtggatggatggaaggaaggaaggaaggaaggaaggaaggaaggatggaaggatggatacatgtatggatggaccaggacaactgttgccctctaacaagagtaggaatctgtcacttctttgtagtttaaaccaggagcttcagaaaatccgtgaaacccctaaaattgtacacaaaattttgtatgtctgtgtctgtttcctttttcattgtaaagaaagttcaggacagctttcatcagaaggcttatattccacaaaaggttcagaacctttggtttaaacttctagaatgatgtaacttaataagtgattgtactcattgtccaagcttccttcatacacacacacacacacacacacacacacacacacacaccccacacacacatctgccgcctgctctatctgtaatgccatctcttctcgctttctctccccttcctgtacagttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttactttttttttttgaaaagataaacttgtaaatagagtgatttgaaatactatatggcaaagttttatatttgatattctttaagttagttgctcacacacttaggctttgattgctgaagaagtatgtttaagagggagagaggggaggcaaagctgaagagagtcaaggtcactgtccccgcttcggcctgaaggaaagagaagacatttctatggccttgctctctgctgtcctgttggtgggcacgacacatcagtggtgttcagtctttatgtgtttttaagcatcccttgggctttggatttggagatgggaagagcatctccaggcaatgagtttttcaaagaatgcctacttagtagtaagatgaagctcaggatttaaataagtggggtcaggcattcgagtttttgtctttcttctcaggtgtatttcttggtacccccaagatatcaggccagaaagagatgagtcagttgctgtgctctttacttctttttctccacatcttctgaggctttagaaatgtggacaagctagttttcaaattttgtgtgcgtctgtaagttcttaaagaaccagcttcttagaatgttcagttctcaatgtgctgctgctttcccttctcctaaacattttaaaactcttccctttcacctccaattcccgtgatcccaaaagaagaggaagactccaggaggggtatagattgtgccgtcatagctttacaggtggttttaaagttagcaggggtttgtcatggtgattcactactcagtttatcagctcaaggattatacagctcttttccgggaactcacccaggagcaagcgagacactaccattgaatcagggaatgagaattaagaatggacaggaccaagacagaactcaagaaagccactggggaaaactcgagaagaaagggagtatactagtaggttagatctgtgaacctgaggacaagaagaccttgggaaatggaggcctcaggggatgtgcattcacatactattacgcttctcaaagagagaccaacatcatgcttttaacacatttgatgaggttttttatttgtgtttttgtttgttttttgagatggagtctcactctgtggcccctgcactccagcctgggtgacagagccagactccgtctcaaaggaaa

SEQ ID NO: 335158 - DNA, 3157 bp, Homo sapiens
cttgccatctggctgccttgccaggcacttcccacgagaggggactaggtagcttacagggaaagggaagaagagagatgaaatgtctggggctttctaagggttttttcaaaaatgttaaataaactcctgttttcacacagcaccacaccgttccggaaggcaaaagccttgtatgcctgcaaagctgaacatgactcagaactttcgttcacagcaggcacggtcttcgataatgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttactttttttttttgaaaagataaacttgtaaatagagtgatttgaaatactatatggcaaagttttatatttgatattctttaagttagttgctcacacacttaggctttgattgctgaagaagtatgtttaagagggagagaggggaggcaaagctgaagagagtcaaggtcactgtccccgcttcggcctgaaggaaagagaagacatttctatggccttgctctctgctgtcctgttggtgggcacgacacatcagtggtgttcagtctttatgtgtttttaagcatcccttgggctttggatttggagatgggaagagcatctccaggcaatgagtttttcaaagaatgcctacttagtagtaagatgaagctcaggatttaaataagtggggtcaggcattcgagtttttgtctttcttctcaggtgtatttcttggtacccccaagatatcaggccagaaagagatgagtcagttgctgtgctctttacttctttttctccacatcttctgaggctttagaaatgtggacaagctagttttcaaattttgtgtgcgtctgtaagttcttaaagaaccagcttcttagaatgttcagttctcaatgtgctgctgctttcccttctcctaaacattttaaaactcttccctttcacctccaattcccgtgatcccaaaagaagaggaagactccaggaggggtatagattgtgccgtcatagctttacaggtggttttaaagttagcaggggtttgtcatggtgattcactactcagtttatcagctcaaggattatacagctcttttccgggaactcacccaggagcaagcgagacactaccattgaatcagggaatgagaattaagaatggacaggaccaagacagaactcaagaaagccactggggaaaactcgagaagaaagggagtatactagtaggttagatctgtgaacctgaggacaagaagaccttgggaaatggaggcctcaggggatgtgcattcacatactattacgcttctcaaagagagaccaacatcatgcttttaacacatttgatgaggttttttatttgtgtttttgtttgttttttgagatggagtctcactctgtggcccctgcactccagcctgggtgacagagccagactccgtctcaaaggaaa

SEQ ID NO: 335159 - DNA, 3408 bp, Homo sapiens
gcccgggcaggtggttgcagcattgcagaagagaaaagtagtttgttggcagagaatcaggtattaatggaaagactcaatcaatctgattctatagaagaccctaacagtccagcaggaagaaggcatttgcagctccagactcaattagaacagctccaagaagaaacattcagactagaagcagccaaagatgattatcgaatacgttgtgaagagttagaaaaggagatctctgaacttcggcaacagaatgatgaactgaccactttggcagatgaagctcagtctctgaaagatgagatcgacgtgctgagacattcttctgataaagtatctaaactagaaggtcaagtatcactagaattcagcggccgctgaattctagggaggcgcgccccccggctgggcgccgcgcgcaccatggggctcccagcgctcgagttcagcgactgctgcctcgatagtccgcacttccgagagacgctcaagtcgcacgaagcagagctggacaagaccaacaaattcatcaaggagctcatcaaggacgggaagtcactcataagcgcgctcaagaatttgtcttcagcgaagcggaagtttgcagattccttaaatgaatttaaatttcagtgcataggagatgcagaaacagatgatgagatgtgtatagcaaggtctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaaatatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggggtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcagcacaccgttccggaaggcaaaagccttgtatgcctgcaaagctgaacatgactcagaactttcgttcacagcaggcacggtcttcgataatgagagtgtccttcagcttccacagccatcttcactgccacaccgaagctccgggcacctccacctctcacctgggcacttccactggccgcctgacacatcttctcacatctgctcttgctgccataaccccctctttacagagcagcgagagtgatctttgaaaaacggaaatggcattaaagcccttcagtggcctcccattgctctgagaattacttacaaggccctccagggcccagttcctgcccctctgacctcacgccctcacttgacatactacagcctcatgccttcttcatgttctcaagcaaggtcggcaaactatgacctgcccgtcaaatccaacctgccacctgtcacctaacaattctgtaactgctcccacatacaacatggtcgtcatcataaatcctataggtattgttgagagcaggaggaaagtttggttgagtgagtgagagaccttacccaagccttcctgtggtctctaggagtcatggcagagttcgctgacactggtctgcttttaaccagccttgccagtgacctttcaaattccctgaggagcaaaaggccaaattgaacctgaaagaaaacacctctcagtgttgactgagttgcagtagaaaatggacctgacaaaacgttagtacactttctcaattgggttagctcaaaatatgttattaggtctttttccttgttccatttcttgttagtttactgctggggatatgaggtaaaggctgtttaatttgtatgctgtgtagttgtcagattaaatcatcaaacc

SEQ ID NO: 335160 - DNA, 1180 bp, Homo sapiens
  misc_feature (9)..(9): n is a, c, g, or t
  misc_feature (1154)..(1154): n is a, c, g, or t
gcaactatnagaggtagcgaggcctgggtggtggagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactcacaccgttccggaaggcaaaagccttgtatgcctgcaaagctgaacatgactcagaactttcgttcacagcaggcacggtcttcgataatgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctcactgatgacaggccaacggctgctttagagatggtgtcgacgggccgcnaatttagtagtagtagtagcggccgc

SEQ ID NO: 335161 - DNA, 1213 bp, Homo sapiens
gcgtcttctatcaccctggcgtcctagcgtgttgttgatgataagttgacgccccccgaatccaagcccaacttcacccctctcgccatcttggcccatgttctcggcgccatccagccctatgcccacctcatccacgtccagcgactcatcccccgtcaggtctgttgcagggtttgtttggttttctgttgctgccgttgttctctcattggctcggtcctctcttcatgcagtgttcagcctcctcgtcaactttgttccctgccatccaaacctgcacttgctttttgacaggccagaagaagcggtacatgaagactccagcacaccgttccggaaggcaaaagccttgtatgcctgcaaagctgaacatgactcagaactttcgttcacagcaggcacggtcttcgataatgagagtgtccttcagcttccacagccatcttcactgccacaccgaagctccgggcacctccacctctcacctgggcacttccactggccgcctgacacatcttctcacatctgctcttgctgccataaccccctctttacagagcagcgagagtgatctttgaaaaacggaaatggcattaaagcccttcagtggcctcccattgctctgagaattacttacaaggccctccagggcccagttcctgcccctctgacctcacgccctcacttgacatactacagcctcatgccttcttcatgttctcaagcaaggtcggcaaactatgacctgcccgtcaaatccaacctgccacctgtcacctaacaattctgtaactgctcccacatacaacatggtcgtcatcataaatcctataggtattgttgagagcaggaggaaagtttggttgagtgagtgagagaccttacccaagccttcctgtggtctctaggagtcatggcagagttcgctgacactggtctgcttttaaccagccttgccagtgacctttcaaattccctgaggagcaaaaggccaaattgaacctgaaagaaaacacctctcagtgttgactgagttgcagtagaaaatggacctgacaaaacgttagtacactttctcaattgggttagctcaaaatatgttattaggtctttttccttgttccatttcttgttagtttactgctggggatatgaggtaaaggctgtttaatttgtatgctgtgtagttgtcagattaaatcatcaaacc

SEQ ID NO: 335162 - DNA, 2549 bp, Homo sapiens
gcccgggcaggtggttgcagcattgcagaagagaaaagtagtttgttggcagagaatcaggtattaatggaaagactcaatcaatctgattctatagaagaccctaacagtccagcaggaagaaggcatttgcagctccagactcaattagaacagctccaagaagaaacattcagactagaagcagccaaagatgattatcgaatacgttgtgaagagttagaaaaggagatctctgaacttcggcaacagaatgatgaactgaccactttggcagatgaagctcagtctctgaaagatgagatcgacgtgctgagacattcttctgataaagtatctaaactagaaggtcaagtatcactagaattcagcggccgctgaattctagggaggcgcgccccccggctgggcgccgcgcgcaccatggggctcccagcgctcgagttcagcgactgctgcctcgatagtccgcacttccgagagacgctcaagtcgcacgaagcagagctggacaagaccaacaaattcatcaaggagctcatcaaggacgggaagtcactcataagcgcgctcaagaatttgtcttcagcgaagcggaagtttgcagattccttaaatgaatttaaatttcagtgcataggagatgcagaaacagatgatgagatgtgtatagcaaggtctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaaatatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggggtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactactgtaagtatgatgtccagctgcctaccccacaagggctttggtcagccattccacctagaatttgctgtctggctccatctgactttggaccattatcccctgaacattatttaaacctcctccctaaactgggag

SEQ ID NO: 335163 - DNA, 1243 bp, Homo sapiens
actggattctttagtttgcataatgttttcaaggttcatccacattgtagcatgtcagaaccttcttcctttttatgtgcgatggtatggatatagcacattttatgtaagcttattcatcagtagatgggcacgttgtttcctctttttggctgcttgaataatgctgctgtgaacatgtgtgtaggtttttgtgagggcgtaggtttccagttctcttggggatatacctaggagtgggattgcagggtcatattaattccgtgtttaagtgtttgaggaaatgccgaactgtttcacaaagaagttgcaccattttaccattttatgttcctaccttctttcatttttaagtctttctgcagtagcttaaatagttaagcataaagggggaaaaaggaagagaagcctggatgattgttaactgccaagtcctttttttccccagcagagtgtccttcagcttccacagccatcttcactgccacaccgaagctccgggcacctccacctctcacctgggcacttccactggccgcctgacacatcttctcacatctgctcttgctgccataaccccctctttacagagcagcgagagtgatctttgaaaaacggaaatggcattaaagcccttcagtggcctcccattgctctgagaattacttacaaggccctccagggcccagttcctgcccctctgacctcacgccctcacttgacatactacagcctcatgccttcttcatgttctcaagcaaggtcggcaaactatgacctgcccgtcaaatccaacctgccacctgtcacctaacaattctgtaactgctcccacatacaacatggtcgtcatcataaatcctataggtattgttgagagcaggaggaaagtttggttgagtgagtgagagaccttacccaagccttcctgtggtctctaggagtcatggcagagttcgctgacactggtctgcttttaaccagccttgccagtgacctttcaaattccctgaggagcaaaaggccaaattgaacctgaaagaaaacacctctcagtgttgactgagttgcagtagaaaatggacctgacaaaacgttagtacactttctcaattgggttagctcaaaatatgttattaggtctttttccttgttccatttcttgttagtttactgctggggatatgaggtaaaggctgtttaatttgtatgctgtgtagttgtcagattaaatcatcaaacc

SEQ ID NO: 335164 - DNA, 892 bp, Homo sapiens
gaattagcctatcgaatggatatgtgatatccgtgcatctctcatacaatagagcatgcacgcatgcaggctttgtcctgttctgcgttttacaacctcattgctgaaattgctctgtgtgctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaaagaaaatagatacaatcagaagagaacttctgcaagctaccaccacaatatccacacctgtgcctatgtttctgccatctctcctgtgcgacaggggaacccagtgctcctacctaaaggcattccctttcctgggacactagagccgattgactccccgttggatctgtaaggacttgggtgcttgagtagtttctccctctttcttctacgccattaacttttctgtctctactaaatctttcccatcagcacataagcatgttgtaatttatgcaatcctttgaaacatgagaaaggaaaaagcaacaactacaaagaatctttctcaatcccatatccccttttaggtactatcccatttttctgtgcttttcccagaagaactcaaatagttgtctgtgcttgctgttcccaaatcctctcttcccactcattctttcttgaacctcaggctttttatgcacactagtccactgaaatgcctcattatcagtattgctgatgacct

SEQ ID NO: 335165 - DNA, 442 bp, Homo sapiens
ctgtggtctctaggagtcatggcagagttcgctgacactggtctgcttttaaccagccttgccagtgacctttcaaattccctgaggagcaaaaggccaaattgaacctgaaagaaaacacctctcagtgttgactgagttgcagtagaaaatggacctgacaaaacgttagtacactttctcaattgggttagctcaaaatatgttattaggtcttttttccagaggaaaatgcttacacagaccctcttcctccccactccttcacctctacaggagaaaatgaggcattacagaacactattattctgtcaggcggtgggtggggtggggggtctttttccttgttccatttcttgttagtttactgctggggatatgaggtaaaggctgtttaatttgtatgctgtgtagttgtcagattaaatcatcaaaccaatca

SEQ ID NO: 335166 - DNA, 817 bp, Homo sapiens
  misc_feature (9)..(9): n is a, c, g, or t
gcaactatnagaggtagcgaggcctgggtggtggagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactaaccaccaccccgaatccagcccaacacaccaggaagtccggtaccagctcgatga

SEQ ID NO: 335167 - DNA, 3757 bp, Homo sapiens
acctagtttcccccacagttaacactattatgatggcacatttgttgtgactaaggaagcaacacaggtacattactactaacccaactctccactttagatttcacttgttttgccctaatgtcctttttaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactcacaccgttccggaaggcaaaagccttgtatgcctgcaaagctgaacatgactcagaactttcgttcacagcaggcacggtcttcgataatgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttactttttttttttgaaaagataaacttgtaaatagagtgatttgaaatactatatggcaaagttttatatttgatattctttaagttagttgctcacacacttaggctttgattgctgaagaagtatgtttaagagggagagaggggaggcaaagctgaagagagtcaaggtcactgtccccgcttcggcctgaaggaaagagaagacatttctatggccttgctctctgctgtcctgttggtgggcacgacacatcagtggtgttcagtctttatgtgtttttaagcatcccttgggctttggatttggagatgggaagagcatctccaggcaatgagtttttcaaagaatgcctacttagtagtaagatgaagctcaggatttaaataagtggggtcaggcattcgagtttttgtctttcttctcaggtgtatttcttggtacccccaagatatcaggccagaaagagatgagtcagttgctgtgctctttacttctttttctccacatcttctgaggctttagaaatgtggacaagctagttttcaaattttgtgtgcgtctgtaagttcttaaagaaccagcttcttagaatgttcagttctcaatgtgctgctgctttcccttctcctaaacattttaaaactcttccctttcacctccaattcccgtgatcccaaaagaagaggaagactccaggaggggtatagattgtgccgtcatagctttacaggtggttttaaagttagcaggggtttgtcatggtgattcactactcagtttatcagctcaaggattatacagctcttttccgggaactcacccaggagcaagcgagacactaccattgaatcagggaatgagaattaagaatggacaggaccaagacagaactcaagaaagccactggggaaaactcgagaagaaagggagtatactagtaggttagatctgtgaacctgaggacaagaagaccttgggaaatggaggcctcaggggatgtgcattcacatactattacgcttctcaaagagagaccaacatcatgcttttaacacatttgatgaggttttttatttgtgtttttgtttgttttttgagatggagtctcactctgtggcccctgcactccagcctgggtgacagagccagactccgtctcaaaggaaa

SEQ ID NO: 335168 - DNA, 3573 bp, Homo sapiens
gcccgggcaggtggttgcagcattgcagaagagaaaagtagtttgttggcagagaatcaggtattaatggaaagactcaatcaatctgattctatagaagaccctaacagtccagcaggaagaaggcatttgcagctccagactcaattagaacagctccaagaagaaacattcagactagaagcagccaaagatgattatcgaatacgttgtgaagagttagaaaaggagatctctgaacttcggcaacagaatgatgaactgaccactttggcagatgaagctcagtctctgaaagatgagatcgacgtgctgagacattcttctgataaagtatctaaactagaaggtcaagtatcactagaattcagcggccgctgaattctagggaggcgcgccccccggctgggcgccgcgcgcaccatggggctcccagcgctcgagttcagcgactgctgcctcgatagtccgcacttccgagagacgctcaagtcgcacgaagcagagctggacaagaccaacaaattcatcaaggagctcatcaaggacgggaagtcactcataagcgcgctcaagaatttgtcttcagcgaagcggaagtttgcagattccttaaatgaatttaaatttcagtgcataggagatgcagaaacagatgatgagatgtgtatagcaaggtctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaaatatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggggtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcaggtctgttgcagggtttgtttggttttctgttgctgccgttgttctctcattggctcggtcctctcttcatgcagtgttcagcctcctcgtcaactttgttccctgccatccaaacctgcacttgctttttgacaggccagaagaagcggtacatgaagactccagcacaccgttccggaaggcaaaagccttgtatgcctgcaaagctgaacatgactcagaactttcgttcacagcaggcacggtcttcgataatgagagtgtccttcagcttccacagccatcttcactgccacaccgaagctccgggcacctccacctctcacctgggcacttccactggccgcctgacacatcttctcacatctgctcttgctgccataaccccctctttacagagcagcgagagtgatctttgaaaaacggaaatggcattaaagcccttcagtggcctcccattgctctgagaattacttacaaggccctccagggcccagttcctgcccctctgacctcacgccctcacttgacatactacagcctcatgccttcttcatgttctcaagcaaggtcggcaaactatgacctgcccgtcaaatccaacctgccacctgtcacctaacaattctgtaactgctcccacatacaacatggtcgtcatcataaatcctataggtattgttgagagcaggaggaaagtttggttgagtgagtgagagaccttacccaagccttcctgtggtctctaggagtcatggcagagttcgctgacactggtctgcttttaaccagccttgccagtgacctttcaaattccctgaggagcaaaaggccaaattgaacctgaaagaaaacacctctcagtgttgactgagttgcagtagaaaatggacctgacaaaacgttagtacactttctcaattgggttagctcaaaatatgttattaggtctttttccttgttccatttcttgttagtttactgctggggatatgaggtaaaggctgtttaatttgtatgctgtgtagttgtcagattaaatcatcaaacc

SEQ ID NO: 335169 - DNA, 3676 bp, Homo sapiens
gcccgggcaggtggttgcagcattgcagaagagaaaagtagtttgttggcagagaatcaggtattaatggaaagactcaatcaatctgattctatagaagaccctaacagtccagcaggaagaaggcatttgcagctccagactcaattagaacagctccaagaagaaacattcagactagaagcagccaaagatgattatcgaatacgttgtgaagagttagaaaaggagatctctgaacttcggcaacagaatgatgaactgaccactttggcagatgaagctcagtctctgaaagatgagatcgacgtgctgagacattcttctgataaagtatctaaactagaaggtcaagtatcactagaattcagcggccgctgaattctagggaggcgcgccccccggctgggcgccgcgcgcaccatggggctcccagcgctcgagttcagcgactgctgcctcgatagtccgcacttccgagagacgctcaagtcgcacgaagcagagctggacaagaccaacaaattcatcaaggagctcatcaaggacgggaagtcactcataagcgcgctcaagaatttgtcttcagcgaagcggaagtttgcagattccttaaatgaatttaaatttcagtgcataggagatgcagaaacagatgatgagatgtgtatagcaaggtctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaaatatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggggtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcaggtctgttgcagggtttgtttggttttctgttgctgccgttgttctctcattggctcggtcctctcttcatgcagtgttcagcctcctcgtcaactttgttccctgccatccaaacctgcacttgctttttgacaggccagaagaagcggtacatgaagactccaggtaaaatctcggatgatgaccaatctgttcccgtttatccaaagctggccagggacaacagggggctgcccctgctctcctgtggttccatcctaagagaccagagctaaaagggaccatttgcatgaatcagcatggcatttttcacacccttttcaaccctgactcaagtttctgaattaacctctctggtgcctagagttaggggaaggagcacctcctgaaccagactctggttttgatggctctctcaatttcatgtgctctctgcactttggtgtaagataacataagaggaaacagtgttgggacatgtgccaaccttttcttttctcatgtttatcaggcagcgtcaggcaatatttatttgtggggttgggcccctggccctaagcactgacacccagtcacttagaccagatccactgggggagagacgtcgaacatagaataaaagcttgagagacgaagcgatttctcttaaattgctcacggcttatgcctcgttgtcccccatatactcccgaaaccatccatgctcccagcctgcttctgtctctgtgtgtcatgaagcctgagctgtcctgggaacaggcactacctctctctgagggagagcagcttgacctagttcctcttctcagggccatgctgtagttttccctgcttttgtgacttccgcacttaagttttttgctcttgtgctctttgggaaaaaaaaagagctctttacaaccgggaaaagaacgaatagggatcctgcagaattcctatgctgtggagctcctaaacgtgcttctctctcaagcttagtctcagctttcagacaaccaaattgtagagcccagttataagcatcagaagcgttttgggctttgggagtattttcccttctgtctttttctccaaagggtggatccagcagagaggcttaaataatttatgaagccgagtttcacttttagaagaaagaaaaccccatgctattt

SEQ ID NO: 335170 - DNA, 2485 bp, Homo sapiens
gcccgggcaggtggttgcagcattgcagaagagaaaagtagtttgttggcagagaatcaggtattaatggaaagactcaatcaatctgattctatagaagaccctaacagtccagcaggaagaaggcatttgcagctccagactcaattagaacagctccaagaagaaacattcagactagaagcagccaaagatgattatcgaatacgttgtgaagagttagaaaaggagatctctgaacttcggcaacagaatgatgaactgaccactttggcagatgaagctcagtctctgaaagatgagatcgacgtgctgagacattcttctgataaagtatctaaactagaaggtcaagtatcactagaattcagcggccgctgaattctagggaggcgcgccccccggctgggcgccgcgcgcaccatggggctcccagcgctcgagttcagcgactgctgcctcgatagtccgcacttccgagagacgctcaagtcgcacgaagcagagctggacaagaccaacaaattcatcaaggagctcatcaaggacgggaagtcactcataagcgcgctcaagaatttgtcttcagcgaagcggaagtttgcagattccttaaatgaatttaaatttcagtgcataggagatgcagaaacagatgatgagatgtgtatagcaaggtctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaaatatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggggtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcacttgttgctaacaaccacaagcagaatttgatgacggtggcaaaccttggtgtggtgtttggacccactctgctga

SEQ ID NO: 335171 - DNA, 878 bp, Homo sapiens
gaattagcctatcgaatggatatgtgatatccgtgcatctctcatacaatagagcatgcacgcatgcaggctttgtcctgttctgcgttttacaacctcattgctgaaattgctctgtgtgctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaagtatgctggaggcttaggaaagaaatgtgtgaaatgttcattgcagtggagaacagcagcaaatgccaagatggccttcccagaggatgctggggaagtgctcatgcaaccaggccaccaagcagagttttcagggggattttacctatggtgatcaagggcaaattggagtgtgttgtccatgataccaggtcaccacacagaattttgtgggattatatgttcttatgctcatcaagaacaaacaaaaatatgttgtgggtttacagaatttgggtttttagtaaagaggactggattctagagctgactctgttattaacctgctgcttaaccagccctgaacaaactgctgaactttctattccttagtttccccatctgtctaatatggataatagactcccctttttctacaaggatcattgatttttgaagttacatgcattaaagcctttgaagaagtataaagaataaaggaattatttttggcaaat

SEQ ID NO: 335172 - DNA, 930 bp, Homo sapiens
agcccgatgccggcggcgcggcgtggcagggttgtggttccgggtcgggccgcgccgcagccagctctcggctcgcagccgcagcgccccgcccccgcgctccggacctggcaggcggcggctgcagggcaggtccaggggccacatggctgagggggacgcagggagcgaccagaggcaggtgaggccccggcggggtgctgtctctccaggctcggctccggctcgcctcgccatgccagtcctcctcagccgaggggccctccgcctggggccgccccgggttccgccagcactggccacgccatttgctccaccgcgttccattttcccggcgcttcccgtcggccgagcgctcttaggccggcggctcctcggcggccgcggtctcggcctgtctcggacggtgtcctcgtcaaccattaacacgcgactaagcagctctgggccgaaggcaaaaaccggggtttcgatccccaccctgccgccgccgagtcatcttggacaaatcacttaagaattcgggtttccccctttgcaaaatggcaatagcccagaccctgcaggtcccgagagcccaccgaatctcactccttctggtccttggcatcgagctttccctgtgccttgttcacgtgggcgatcataagtcttttcctacagggctgtgagtacaaaatgaaatgctacgaagtcgaatggatactttgcttcccatcttttccctttaggtcctccagttatttttcttttttaaccccaagcccaaagaataatttatgaaacgttttaagggtttgattaccaagcaaccacccacccatctagtccttgtgtaccccctccccacctccccccaacacaaaatttaatacgaaggaaccagtgagacacccagcaggagtacacagataatgtggggcagagcta

SEQ ID NO: 335173 - DNA, 3558 bp, Homo sapiens
agcccgatgccggcggcgcggcgtggcagggttgtggttccgggtcgggccgcgccgcagccagctctcggctcgcagccgcagcgccccgcccccgcgctccggacctggcaggcggcggctgcagggcaggtccaggggccacatggctgagggggacgcagggagcgaccagaggcagaatgaggaaattgaagcaatggcagccatttatggcgaggagtggtgtgtcattgatgactgtgccaaaatattttgtattagaattagcgacgatatagatgaccccaaatggacactttgcttgcaggtgatgctgccgaatgaatacccaggtacagctccacctatctaccagttgaatgctccttggcttaaagggcaagaacgtgcggatttatcaaatagccttgaggaaatatatattcagaatatcggtgaaagtattctttacctgtgggtggagaaaataagagatgttcttatacaaaaatctcagatgacagaaccaggcccagatgtaaagaagaaaactgaagaggaagatgttgaatgtgaagatgatctcattttagcatgtcagccggaaagttcggttaaagcattggattttgatatcagtgaaactcggacagaagtagaagtagaagaattacctccgattgatcatggcattcctattacagaccgaagaagtacttttcaggcacacttggctccagtggtttgtcccaaacaggtgaaaatggttctttccaaattgtatgagaataagaaaatagctagtgccacccacaacatctatgcctacagaatatattgtgaggataaacagaccttcttacaggattgtgaggatgatggggaaacagcagctggtgggcgtcttcttcatctcatggagattttgaatgtgaagaatgtcatggtggtagtatcacgctggtatggagggattctgctaggaccagatcgctttaaacatatcaacaactgtgccagaaacatactagtggaaaagaactacacaaattcacctgaggagtcatctaaggctttgggaaagaacaaaaaagcttatttgggagaactaatttgaacttaatcaccacttcatctaattttagcaaggtaacagttgcccagggcagtacctgaattaactgtccatttcagtacatgtcaagtgcctttgttaggtggagaagaaatgtctctagaggaatataaatacctgatttcttgtcatcgagattcttgtactgttaaatgaatattgccttttactgctctttatggcttattggaataggagctcatttaagattgatcttggagagtttcttcttgtgattttagttcataagtatgtcacctttcattttatagtgttcatcattgagtaatggattaagtgaaaatccaggagtatccatctgcagttatgtgctgaggtgataattcatccaacatatttgttagcataaatattatgcttcagtttctgttgcaaattggtgattgtgaaattacagaaagtgattttctagtctgctttttttgtttaattcttgtaatgtaagcaataaatatggagtgtcagtagtctccttccaccccagaaatgtgttggtgtaacattctcgtttcttttaacaacctggaagtacctttcttgtgatcttcactgaggaattagaactatgatagaagttaggctgtggcaaatgggacattcgtagagtgggatagaggtggcagaatgaacctggtgtagggcaggagtatgttgtgtagttacatcaatttgatgcatgctttccatctgcactccagacggctttctcagttccaagattttgcagagagaaggagcaaaccttttcattggaaaaacagaaacaaccctcccccccattttttcccctctattcatcaaacctttatgtatctttcatcttccagttacctctaggcatttagatagtgaaatttacctttgagatataacaataagtgattaactgttcactttcagatgtaatggcaaacaattgttaaaagttattaactgatcacagatttgcctggacttcccttcccagggagggaacagaagttaggaggcaactttgggatggtgctagagcatggaaagcacagagaattggacaaacaggtctttttctcttttctctgatgttttacctttaaaagatccaacatccttaccgttggtatttttagtaaggttatagtaaatagctttacaccaggatggattctgaaatataaattctaaattatatttgttataactatattttatgttgtatgttatcaggagccatcagagaatgacctttttgtgtttggaacacttggttccatgaaaagtatgctttgtgttttaactgttaaaataatttaaaaattaattattttacataattaaagaagttaaaaactattaacattaaataatttcacaatttcaacatgtcaaacctatgaagggagataggaaacaatgagaaacttacttttgctcctttatacagaattattaactatattttactaactaaaaaactctagtattctttacctaaagtcaattggctggtaagagggagagatgcaaaattctccagctctgaacttggagctacttcacactctactcttaatggaaacttgaactaatgatagatagtatttttttcctctatttaaaatttttgtcttgattaggagatttttcagttctccatataataattttctacaatcagatctatgctgtggcatattttgctttatttaaaaatttttttttagagatgagttcttgctctgtcacctaggctggagtgcagtggcatgatcatggctcactgcagccttgaccttccagcctgccaagtagctgggattacagacaggcatgtgctattacacctggctaatttttaaagttttttttgtaaagatagggtctttctatgttgcccaggctcgtcttgagctcctggcctcaatcgatcttcctgccaaggttttggaattacaggtgtgagccaccatgcctggcctgctttgacatattttatagtgtgttaattacaaatagtcttcatatgccagaatataagagcaagtgttatctactttttagatgggaattgcagaagctgcatcaaaagtatgctttgaggtatatatagtgaaacagagcctttctgaagagaattatatcaaactaattacaaccaagaaataatagtatgaagcggatgctgtttggaggacaggaaaatttatcaggaaaattacataatccctctgattccactatccagagatagccattattattaatatttggtatgtacatccttatattatttttttcttatgcatgattttgtatatatggttatttttctttccataaaaatggtattaaactgtatatactgttttgtagcctacatatttcatatagaagtatattgttaacattttccatgtcaataaatattcttctatggctta

SEQ ID NO: 335174 - DNA, 3192 bp, Homo sapiens
agcccgatgccggcggcgcggcgtggcagggttgtggttccgggtcgggccgcgccgcagccagctctcggctcgcagccgcagcgccccgcccccgcgctccggacctggcaggcggcggctgcagggcaggtccaggggccacatggctgagggggacgcagggagcgaccagaggcagaatgaggaaattgaagcaatggcagccatttatggcgaggagtggtgtgtcattgatgactgtgccaaaatattttgtattagaattagcgacgatatagatgaccccaaatggacactttgcttgcaggtgatgctgccgaatgaatacccaggtacagctccacctatctaccagttgaatgctccttggcttaaagggcaagaacgtgcggatttatcaaatagccttgaggaaatatatattcagaatatcggtgaaagtattctttacctgtgggtggagaaaataagagatgttcttatacaaaaatctcagatgacagaaccaggcccagatgtaaagaagaaaactgaagaggaagatgttgaatgtgaagatgatctcattttagcatgtcagccggaaagttcggttaaagcattggattttgatatcagtgaaactcggacagaagtagaagtagaagaattacctccgattgatcatggcattcctattacagaccgaagaagtacttttcaggcacacttggctccagtggtttgtcccaaacaggtgaaaatggttctttccaaattgtatgagaataagaaaatagctagtgccacccacaacatctatgcctacagaatatattgtgaggataaacagaccttcttacaggattgtgaggatgatggggaaacagcagctggtgggcgtcttcttcatctcatggaggtaggtgtaagttaaactatcaatcctgaggagtcatctaaggctttgggaaagaacaaaaaagcttatttgggagaactaatttgaacttaatcaccacttcatctaattttagcaagtgttcatcattgagtaatggattaagtgaaaatccaggagtatccatctgcagttatgtgctgaggtgataattcatccaacatatttgttagcataaatattatgcttcagtttctgttgcaaattggtgattgtgaaattacagaaagtgattttctagtctgctttttttgtttaattcttgtaatgtaagcaataaatatggagtgtcagtagtctccttccaccccagaaatgtgttggtgtaacattctcgtttcttttaacaacctggaagtacctttcttgtgatcttcactgaggaattagaactatgatagaagttaggctgtggcaaatgggacattcgtagagtgggatagaggtggcagaatgaacctggtgtagggcaggagtatgttgtgtagttacatcaatttgatgcatgctttccatctgcactccagacggctttctcagttccaagattttgcagagagaaggagcaaaccttttcattggaaaaacagaaacaaccctcccccccattttttcccctctattcatcaaacctttatgtatctttcatcttccagttacctctaggcatttagatagtgaaatttacctttgagatataacaataagtgattaactgttcactttcagatgtaatggcaaacaattgttaaaagttattaactgatcacagatttgcctggacttcccttcccagggagggaacagaagttaggaggcaactttgggatggtgctagagcatggaaagcacagagaattggacaaacaggtctttttctcttttctctgatgttttacctttaaaagatccaacatccttaccgttggtatttttagtaaggttatagtaaatagctttacaccaggatggattctgaaatataaattctaaattatatttgttataactatattttatgttgtatgttatcaggagccatcagagaatgacctttttgtgtttggaacacttggttccatgaaaagtatgctttgtgttttaactgttaaaataatttaaaaattaattattttacataattaaagaagttaaaaactattaacattaaataatttcacaatttcaacatgtcaaacctatgaagggagataggaaacaatgagaaacttacttttgctcctttatacagaattattaactatattttactaactaaaaaactctagtattctttacctaaagtcaattggctggtaagagggagagatgcaaaattctccagctctgaacttggagctacttcacactctactcttaatggaaacttgaactaatgatagatagtatttttttcctctatttaaaatttttgtcttgattaggagatttttcagttctccatataataattttctacaatcagatctatgctgtggcatattttgctttatttaaaaatttttttttagagatgagttcttgctctgtcacctaggctggagtgcagtggcatgatcatggctcactgcagccttgaccttccagcctgccaagtagctgggattacagacaggcatgtgctattacacctggctaatttttaaagttttttttgtaaagatagggtctttctatgttgcccaggctcgtcttgagctcctggcctcaatcgatcttcctgccaaggttttggaattacaggtgtgagccaccatgcctggcctgctttgacatattttatagtgtgttaattacaaatagtcttcatatgccagaatataagagcaagtgttatctactttttagatgggaattgcagaagctgcatcaaaagtatgctttgaggtatatatagtgaaacagagcctttctgaagagaattatatcaaactaattacaaccaagaaataatagtatgaagcggatgctgtttggaggacaggaaaatttatcaggaaaattacataatccctctgattccactatccagagatagccattattattaatatttggtatgtacatccttatattatttttttcttatgcatgattttgtatatatggttatttttctttccataaaaatggtattaaactgtatatactgttttgtagcctacatatttcatatagaagtatattgttaacattttccatgtcaataaatattcttctatggctta

SEQ ID NO: 335175 - DNA, 3790 bp, Homo sapiens
agcccgatgccggcggcgcggcgtggcagggttgtggttccgggtcgggccgcgccgcagccagctctcggctcgcagccgcagcgccccgcccccgcgctccggacctggcaggcggcggctgcagggcaggtccaggggccacatggctgagggggacgcagggagcgaccagaggcagaatgaggaaattgaagcaatggcagccatttatggcgaggagtggtgtgtcattgatgactgtgccaaaatattttgtattagaattagcgacgatatagatgaccccaaatggacactttgcttgcaggtgatgctgccgaatgaatacccaggtacagctccacctatctaccagttgaatgctccttggcttaaagggcaagaacgtgcggatttatcaaatagccttgaggaaatatatattcagaatatcggtgaaagtattctttacctgtgggtggagaaaataagagatgttcttatacaaaaatctcagatgacagaaccaggcccagatgtaaagaagaaaactgaagaggaagatgttgaatgtgaagatgatctcattttagcatgtcagccggaaagttcggttaaagcattggattttgatatcagtgaaactcggacagaagtagaagtagaagaattacctccgattgatcatggcattcctattacagaccgaagaagtacttttcaggcacacttggctccagtggtttgtcccaaacaggtgaaaatggttctttccaaattgtatgagaataagaaaatagctagtgccacccacaacatctatgcctacagaatatattgtgaggataaacagaccttcttacaggattgtgaggatgatggggaaacagcagctggtgggcgtcttcttcatctcatggagattttgaatgtgaagaatgtcatggtggtagtatcacgctggtatggagggattctgctaggaccagatcgctttaaacatatcaacaactgtgccagaaacatactagtggaaaagaactacacaaattcacctgaggagtcatctaaggctttgggaaagaacaaaaaagtaagaaaagacaagaagaggaatgaacattaatacctgaaactataggaaaggttaatttgcctataattatatatacattccatagtcatcaaggaatatattgtgcagagagagtatccttgactgcttaagtcagccagttcagcatggataccaacattagcttttcttcttggttatatcatctgccaaaaatagagaacttatgatctattcatgtgtgtttcaggcttatttgggagaactaatttgaacttaatcaccacttcatctaattttagcaaggtaacagttgcccagggcagtacctgaattaactgtccatttcagtacatgtcaagtgcctttgttaggtggagaagaaatgtctctagaggaatataaatacctgatttcttgtcatcgagattcttgtactgttaaatgaatattgccttttactgctctttatggcttattggaataggagctcatttaagattgatcttggagagtttcttcttgtgattttagttcataagtatgtcacctttcattttatagtgttcatcattgagtaatggattaagtgaaaatccaggagtatccatctgcagttatgtgctgaggtgataattcatccaacatatttgttagcataaatattatgcttcagtttctgttgcaaattggtgattgtgaaattacagaaagtgattttctagtctgctttttttgtttaattcttgtaatgtaagcaataaatatggagtgtcagtagtctccttccaccccagaaatgtgttggtgtaacattctcgtttcttttaacaacctggaagtacctttcttgtgatcttcactgaggaattagaactatgatagaagttaggctgtggcaaatgggacattcgtagagtgggatagaggtggcagaatgaacctggtgtagggcaggagtatgttgtgtagttacatcaatttgatgcatgctttccatctgcactccagacggctttctcagttccaagattttgcagagagaaggagcaaaccttttcattggaaaaacagaaacaaccctcccccccattttttcccctctattcatcaaacctttatgtatctttcatcttccagttacctctaggcatttagatagtgaaatttacctttgagatataacaataagtgattaactgttcactttcagatgtaatggcaaacaattgttaaaagttattaactgatcacagatttgcctggacttcccttcccagggagggaacagaagttaggaggcaactttgggatggtgctagagcatggaaagcacagagaattggacaaacaggtctttttctcttttctctgatgttttacctttaaaagatccaacatccttaccgttggtatttttagtaaggttatagtaaatagctttacaccaggatggattctgaaatataaattctaaattatatttgttataactatattttatgttgtatgttatcaggagccatcagagaatgacctttttgtgtttggaacacttggttccatgaaaagtatgctttgtgttttaactgttaaaataatttaaaaattaattattttacataattaaagaagttaaaaactattaacattaaataatttcacaatttcaacatgtcaaacctatgaagggagataggaaacaatgagaaacttacttttgctcctttatacagaattattaactatattttactaactaaaaaactctagtattctttacctaaagtcaattggctggtaagagggagagatgcaaaattctccagctctgaacttggagctacttcacactctactcttaatggaaacttgaactaatgatagatagtatttttttcctctatttaaaatttttgtcttgattaggagatttttcagttctccatataataattttctacaatcagatctatgctgtggcatattttgctttatttaaaaatttttttttagagatgagttcttgctctgtcacctaggctggagtgcagtggcatgatcatggctcactgcagccttgaccttccagcctgccaagtagctgggattacagacaggcatgtgctattacacctggctaatttttaaagttttttttgtaaagatagggtctttctatgttgcccaggctcgtcttgagctcctggcctcaatcgatcttcctgccaaggttttggaattacaggtgtgagccaccatgcctggcctgctttgacatattttatagtgtgttaattacaaatagtcttcatatgccagaatataagagcaagtgttatctactttttagatgggaattgcagaagctgcatcaaaagtatgctttgaggtatatatagtgaaacagagcctttctgaagagaattatatcaaactaattacaaccaagaaataatagtatgaagcggatgctgtttggaggacaggaaaatttatcaggaaaattacataatccctctgattccactatccagagatagccattattattaatatttggtatgtacatccttatattatttttttcttatgcatgattttgtatatatggttatttttctttccataaaaatggtattaaactgtatatactgttttgtagcctacatatttcatatagaagtatattgttaacattttccatgtcaataaatattcttctatggctta

SEQ ID NO: 335176 - DNA, 3737 bp, Homo sapiens
agcccgatgccggcggcgcggcgtggcagggttgtggttccgggtcgggccgcgccgcagccagctctcggctcgcagccgcagcgccccgcccccgcgctccggacctggcaggcggcggctgcagggcaggtccaggggccacatggctgagggggacgcagggagcgaccagaggcagaatgaggaaattgaagcaatggcagccatttatggcgaggagtggtgtgtcattgatgactgtgccaaaatattttgtattagaattagcgacgatatagatgaccccaaatggacactttgcttgcaggtgatgctgccgaatgaatacccaggtacagctccacctatctaccagttgaatgctccttggcttaaagggcaagaacgtgcggatttatcaaatagccttgaggaaatatatattcagaatatcggtgaaagtattctttacctgtgggtggagaaaataagagatgttcttatacaaaaatctcagatgacagaaccaggcccagatgtaaagaagaaaactgaagaggaagatgttgaatgtgaagatgatctcattttagcatgtcagccggaaagttcggttaaagcattggattttgatatcagtgaaactcggacagaagtagaagtagaagaattacctccgattgatcatggcattcctattacagaccgaagaagtacttttcaggcacacttggctccagtggtttgtcccaaacaggtgaaaatggttctttccaaattgtatgagaataagaaaatagctagtgccacccacaacatctatgcctacagaatatattgtgaggataaacagaccttcttacaggattgtgaggatgatggggaaacagcagctggtgggcgtcttcttcatctcatggagattttgaatgtgaagaatgtcatggtggtagtatcacgctggtatggagggattctgctaggaccagatcgctttaaacatatcaacaactgtgccagaaacatactagtggaaaagaactacacaaattcacctgaggagtcatctaaggctttgggaaagaacaaaaaagtaagaaaagacaagaagaggaatgaacattaatacctgaaactataggaaaggttaatttgcctataattatatatacattccatagtcatcaaggaatatattgtgcagagagagtatccttgactgcttaagtcagccagttcagcatggataccaacattagcttttcttcttggttatatcatctgccaaaaatagagaacttatgatctattcatgtgtgtttcaggcttatttgggagaactaatttgaacttaatcaccacttcatctaattttagcaaggtaacagttgcccagggcagtacctgaattaactgtccatttcagtacatgtcaagtgcctttgttaggtggagaagaaatgtctctagaggaatataaatacctgatttcttgtcatcgagattcttgtactgttaaatgaatattgccttttactgctctttatggcttattggaataggagctcatttaagattgatcttggagagtttcttcttgtgattttagttcataagtatgtcacctttcattttatagtgttcatcattgagtaatggattaagtgaaaatccaggagtatccatctgcagttatgtgctgaggtgataattcatccaacatatttgttagcataaatattatgcttcagtttctgttgcaaattggtgattgtgaaattacagaaagtgattttctagtctgctttttttgtttaattcttgtaatgtaagcaataaatatggagtgtcagtagtctccttccaccccagaaatgtgttggtgtaacattctcgtttcttttaacaacctggaagtacctttcttgtgatcttcactgaggaattagaactatgatagaagttaggctgtggcaaatgggacattcgtagagtgggatagaggtggcagaatgaacctggtgtagggcaggagtatgttgtgtagttacatcaatttgatgcatgctttccatctgcactccagacggctttctcagttccaagattttgcagagagaaggagcaaaccttttcattggaaaaacagaaacaaccctcccccccattttttcccctctattcatcaaacctttatgtatctttcatcttccagttacctctaggcatttagatagtgaaatttacctttgagatataacaataagtgattaactgttcactttcagatgtaatggcaaacaattgttaaaagttattaactgatcacagatttgcctggacttcccttcccagggagggaacagaagttaggaggcaactttgggatggtgctagagcatggaaagcacagagaattggacaaacaggtctttttctcttttctctgatgttttacctttaaaagatccaacatccttaccgttggtatttttagtaaggttatagtaaatagctttacaccaggatggattctgaaatataaattctaaattatatttgttataactatattttatgttgtatgttatcaggagccatcagagaatgacctttttgtgtttggaacacttggttccatgaaaagtatgctttgtgttttaactgttaaaataatttaaaaattaattattttacataattaaagaagttaaaaactattaacattaaataatttcacaatttcaacatgtcaaacctatgaagggagataggaaacaatgagaaacttacttttgctcctttatacagaattattaactatattttactaactaaaaaactctagtattctttacctaaagtcaattggctggtaagagggagagatgcaaaattctccagctctgaacttggagctacttcacactctactcttaatggaaacttgaactaatgatagatagtatttttttcctctatttaaaatttttgtcttgattaggagatttttcagttctccatataataattttctacaatcagatctatgctgtggcatattttgctttatttatggcatgatcatggctcactgcagccttgaccttccagcctgccaagtagctgggattacagacaggcatgtgctattacacctggctaatttttaaagttttttttgtaaagatagggtctttctatgttgcccaggctcgtcttgagctcctggcctcaatcgatcttcctgccaaggttttggaattacaggtgtgagccaccatgcctggcctgctttgacatattttatagtgtgttaattacaaatagtcttcatatgccagaatataagagcaagtgttatctactttttagatgggaattgcagaagctgcatcaaaagtatgctttgaggtatatatagtgaaacagagcctttctgaagagaattatatcaaactaattacaaccaagaaataatagtatgaagcggatgctgtttggaggacaggaaaatttatcaggaaaattacataatccctctgattccactatccagagatagccattattattaatatttggtatgtacatccttatattatttttttcttatgcatgattttgtatatatggttatttttctttccataaaaatggtattaaactgtatatactgttttgtagcctacatatttcatatagaagtatattgttaacattttccatgtcaataaatattcttctatggctta

SEQ ID NO: 335177 - DNA, 2066 bp, Homo sapiens
agcccgatgccggcggcgcggcgtggcagggttgtggttccgggtcgggccgcgccgcagccagctctcggctcgcagccgcagcgccccgcccccgcgctccggacctggcaggcggcggctgcagggcaggtccaggggccacatggctgagggggacgcagggagcgaccagaggcagaatgaggaaattgaagcaatggcagccatttatggcgaggagtggtgtgtcattgatgactgtgccaaaatattttgtattagaattagcgacgatatagatgaccccaaatggacactttgcttgcaggtgatgctgccgaatgaatacccaggtacagctccacctatctaccagttgaatgctccttggcttaaagggcaagaacgtgcggatttatcaaatagccttgaggaaatatatattcagaatatcggtgaaagtattctttacctgtgggtggagaaaataagagatgttcttatacaaaaatctcagatgacagaaccaggcccagatgtaaagaagaaaactgaagaggaagatgttgaatgtgaagatgatctcattttagcatgtcagccggaaagttcggttaaagcattggattttgatatcagtgaaactcggacagaagtagaagtagaagaattacctccgattgatcatggcattcctattacagaccgaagaagtacttttcaggcacacttggctccagtggtttgtcccaaacaggtgaaaatggttctttccaaattgtatgagaataagaaaatagctagtgccacccacaacatctatgcctacagaatatattgtgaggataaacagaccttcttacaggattgtgaggatgatggggaaacagcagctggtgggcgtcttcttcatctcatggagattttgaatgtgaagaatgtcatggtggtagtatcacgctggtatggagggattctgctaggaccagatcgctttaaacatatcaacaactgtgccagaaacatactagtggaaaagaactacacaaattcacctgaggagtcatctaaggctttgggaaagaacaaaaaagtaagaaaagacaagaagaggaatgaacattaatacctgaaactataggaaaggttaatttgcctataattatatatacattccatagtcatcaaggaatatattgtgcagagagagtatccttgactgcttaagtcagccagttcagcatggataccaacattagcttttcttcttggttatatcatctgccaaaaatagagaacttatgatctattcatgtgtgtttcaggcttatttgggagaactaatttgaacttaatcaccacttcatctaattttagcaaggtaacagttgcccagggcagtacctgaattaactgtccatttcagtacatgtcaagtgcctttgttaggtggagaagaaatgtctctagaggaatataaatacctgatttcttgtcatcgagattcttgtactgttaaatgaatattgccttttactgctctttatggcttattggaataggagctcatttaagattgatcttggagagtttcttcttgtgattttagttcataagtatgtcacctttcattttatagtgttcatcattgagtaatggattaagtgaaaatccaggagtatccatctgcagttatgtgctgagatgggaattgcagaagctgcatcaaaagtatgctttgaggtatatatagtgaaacagagcctttctgaagagaattatatcaaactaattacaaccaagaaataatagtatgaagcggatgctgtttggaggacaggaaaatttatcaggaaaattacataatccctctgattccactatccagagatagccattattattaatatttggtatgtacatccttatattatttttttcttatgcatgattttgtatatatggttatttttctttccataaaaatggtattaaactgtatatactgttttgtagcctacatatttcatatagaagtatattgttaacattttccatgtcaataaatattcttctatggctta

SEQ ID NO: 335178 - DNA, 1573 bp, Homo sapiens
agcccgatgccggcggcgcggcgtggcagggttgtggttccgggtcgggccgcgccgcagccagctctcggctcgcagccgcagcgccccgcccccgcgctccggacctggcaggcggcggctgcagggcaggtccaggggccacatggctgagggggacgcagggagcgaccagaggcagaatgaggaaattgaagcaatggcagccatttatggcgaggagtggtgtgtcattgatgactgtgccaaaatattttgtattagaattagcgacgatatagatgaccccaaatggacactttgcttgcaggtgatgctgccgaatgaatacccaggtacagctccacctatctaccagttgaatgctccttggcttaaagggcaagaacgtgcggatttatcaaatagccttgaggaaatatatattcagaatatcggtgaaagtattctttacctgtgggtggagaaaataagagatgttcttatacaaaaatctcagatgacagaaccaggcccagatgtaaagaagaaaactgaagaggaagatgttgaatgtgaagatgatctcattttagcatgtcagccggaaagttcggttaaagcattggattttgatatcagtgaaactcggacagaagtagaagtagaagaattacctccgattgatcatggcattcctattacagaccgaagaagtacttttcaggcacacttggctccagtggtttgtcccaaacaggtgaaaatggttctttccaaattgtatgagaataagaaaatagctagtgccacccacaacatctatgcctacagaatatattgtgaggataaacagaccttcttacaggattgtgaggatgatggggaaacagcagctggtgggcgtcttcttcatctcatggagattttgaatgtgaagaatgtcatggtggtagtatcacgctggtatggagggattctgctaggaccagatcgctttaaacatatcaacaactgtgccagaaacatactagtggaaaagaactacacaaattcacctgaggagtcatctaaggctttgggaaagaacaaaaaagtaagaaaagacaagaagaggaatgaacattaatacctgaaactataggaaagtgttcatcattgagtaatggattaagtgaaaatccaggagtatccatctgcagttatgtgctgagatgggaattgcagaagctgcatcaaaagtatgctttgaggtatatatagtgaaacagagcctttctgaagagaattatatcaaactaattacaaccaagaaataatagtatgaagcggatgctgtttggaggacaggaaaatttatcaggaaaattacataatccctctgattccactatccagagatagccattattattaatatttggtatgtacatccttatattatttttttcttatgcatgattttgtatatatggttatttttctttccataaaaatggtattaaactgtatatactgttttgtagcctacatatttcatatagaagtatattgttaacattttccatgtcaataaatattcttctatggctta

SEQ ID NO: 335179 - DNA, 87 bp, Homo sapiens
cttctcaatcttgccatccttctaagttaccaccctagttctctttctctctttacactgaaatatttaattaaatatttctcattc

SEQ ID NO: 335180 - DNA, 435 bp, Homo sapiens
ttactatgtgccagggaggagtactagttattaactcatttaatcctcacaaaaacacaatgaattagttactaccattatactcattttacagacaagaaaacagaggcacagagaaatcaaataacttgcctaagattacacagactaaaatccagatactgatggaaccacaatctcttgttacagaaatcaagcatttagtgattcagcacaaaacaatgtacattgaattcttatcaagcaagttattgtgttatgcactctataagggacagaaaacttagtaagaaaaaatctgttttatctagcatttctattacattctttatctagcctgctttaattggtgatgattttgtgtttaaaccttgctttcttaactaggatacctgcaagtatttacaatgctaagtggaaattaaacaaatacaa

SEQ ID NO: 335181 - DNA, 1107 bp, Homo sapiens
actcaaaatttgaaaaataagcacatccaatgattgttttgaccaacagtggtcagtgacgtaaactgcatgtgcatctgaggacatttaaggggtcattaaaatttgaggagcatcaggccggagtagcagacttttagatgagtcatatttcagcattcactaagtcctcagcattccattcaaactgtcgtgtatatttggcctgattttttttcaagctttgcaataatttatgttattggtaaacacttggtgactatatctcagccttttctttaacaactcacaatatattagaaacacgtctacctatactgagagtatatttacaatagaagaacatactgtatgtgactttgtaaagctagacttttgattaagaaatatataatctctggatggtatttttgcattatacactcaggcacaacgtaaaccttgatggctcatcttgctacaattacgagttgaaaaacactacttacgtatttgtatgacctattagtcagaggaaatcatacatatgctttgtaaatagactttgcagataactaaatagactgaagaaatatgttgcatttgatagaagcaattgcataaatatttggtttctatattagagtctgtgagtaaagtcaagtaataaacctaagtaggtataacagatttttaaaccttgaaacttgctttgatggtagagaaaatcattgaagatttacatactgtatataagatgtaaaatgtacgctgcttattaccctcaattttccagaagcaatggtatataatgcagttgaaaaaccaaaaatcttggaaaactaagacgggtcttgtttaaaatgtctctcagctttggcaaccttcaaatcttaatcaactatttaaagcattactgtgtcttgtagcctgcattccacaacagctctgttattcaggtaaaagacttgaactgagccgtttgggacctatactgtaatattttcattgaggaacaatatcctattttgtaaagcatttccctatgtgtgactttaaactgtaaaattaaacactgcttttgtgggttcagtgggcataataaatataaattgtaaactaaaaaaa

SEQ ID NO: 335182 - DNA, 265 bp, Homo sapiens
ccattcaatctgactcctgtttgtttacatatatatgtttgtgatatcacaaagtcaaaatagcttatctcaagtccccactcttgaaattaaaaaaaaaatgttctgtagctaaccattaatgcatttaggaagaggatacatttccaaaaccatatttaaaaaaataaagttaggaattacagttaaaagattaccataaactgttaacgatgtgcatatagttaacacttaacacttaaaaatggttaagatggggccaacc

SEQ ID NO: 335183 - DNA, 530 bp, Homo sapiens
ctggaggagcaactgtgaggccccgagatggggagggagcccagattctggcttttggtcttcctgctgtttcttttgtctgatgctggtgcatttccatggacagtttatttcccttggacactgtgggcttggtttttccatgagtgtgtgacgctgtggtcattcaccaggccctgttggtggtctcggtgggggccacaaggctcagatctcacctgccccttttcctacctcctccactctttgctcagccatcaacattcctttctgtcccagaagtgttctttccaaaatgcagatctgcccatgtcccctaatgacgtcacttattgacttcgctatggaaaaggagcgatggggaatgtggccggaaggacagcagagagccagactgtggagacctttgaattccagaggaacaaaagtattttgggtggctcacacctgtaatcccagcactttgggagaccaaggcgggcagatcacctgaggtcaggagcttgagaccagcctgaccaacatggtag

SEQ ID NO: 335184 - DNA, 145 bp, Homo sapiens
tgggccagcagtttaacttaggtgtttttcaatttaaggttccggccttcccattacatgtttctttattttatagaaagtgtaagttaggccgggcacagtggctcaggcctgaaatctcagcattttgggaggccagtgcaga

SEQ ID NO: 335185 - DNA, 213 bp, Homo sapiens
agaaagaaggaaagaaggagagaaagaaagagaggaaggaaggaaggaaggaaggaaggaaggaaggttggttagttggtttataggttttggctatagccaactaaaaatggctgaaaacaactgggtgaaatggcccagaaaacaactataaagcttcaagctaaaaggaaatcacaccagatagtcacttcaatccataggaaatgaagg

SEQ ID NO: 335186 - DNA, 155 bp, Homo sapiens
cgtaaaacttgttatactccttagctgaatttggaaaaaaagaaagagcaaaactaatgagcaacatttaagccacattacctagccgcgtagtcagatcgagccgcgtagtcagatcgagccgcgtagtcagatcgagccgcgtagtcagatcg

SEQ ID NO: 335187 - DNA, 393 bp, Homo sapiens
ttcattctgactgaagggaatgtccagttccctgggtgacagatataagcttgaatggaggattctttaggactgttccacaaactaggtctgttgtggatccagtcatttctgggtctcatgcagacccctctccaggtgccaggatggtaccctgtaccagataggaatcatattttctgggtttatgggccacccggagtgcacctctccctgcaaagcacagggccagctgtcctctttgaaggagggctgtaatgataaactgcacatgcctgcttctggacactagagtcctctagagcaattgccacaccacagagtatctgcaaaacatacacagcaccagccacctccccctgccacctccactgcacatctgaaagctggcag

SEQ ID NO: 335188 - DNA, 430 bp, Homo sapiens
ctcactttcctcacctgtgaaaaggaggttgaggatcctcgtggctggagaatgactcgggctcagatgggatgctgttttgtaacagtgccaccttcactagcatttgctcgtctctggtgagtgtcatcaagggcacatgctctgagaactgagtcagagatggagaagaaagatggagggtaatgtggggtttaagaagagagagaaaatgtgtgtcactctttaaaatgacaagtgatagcagaaatgcattagtgctcccaagctgtccattacattctccaaactggagctgctgtggggtgtagttcacagctgggcctgctgagaactgtgagctgcctgttggacagcctagagagcctgcatgtcacctctgaaggacaaagaccaggaaggagggaagtgcaggaaggagggggctggg

SEQ ID NO: 335189 - DNA, 509 bp, Homo sapiens
aatacacattgagtgaaatgttattggggactggacatttatagtctcaaagtatcatcctgtagatacttactatttcaaagaggaagaattgcctttaaatggaaaatggtggacaccaccataaccataggaatccaccaataatggaacagggacagacagacatgatgaaggacacacatcttgtcagaagtgttggatctaaatataatcatagggacattatctgacagatggacattctacaaaagcaagtggtctggtctccaaaaatgacattgtcaagaaagaaaaaggcagagaactcttctagagactaaggaaatatgacagctaaaagcagcgcatgatccttgattggatcctgattgaaaacagcagctataaaagaaattggggaataattgggaaatttgcaggtggttgtatatcagctaagaaagttaacattgatacagtagtaagattgttgatggtgttgaagtgcttagggatgaagtttcatt

SEQ ID NO: 335190 - DNA, 749 bp, Homo sapiens
cgttgattaagtaaaacttgcttttctattttttatgtgagagctcattttgccatttgggtatgtcactttcatttatgtacttaggaagcattaggatttaagaacattgttaaaataagtctttataactttagaaatgtggttactttgaaaatggaaaaacctagactagccttactactttttttagataacagggaagacttatggaaatgaatgaaaggcaaattcaattggaaaaaagagattaatttcttattaaatcaaattctctgtatttataaattttgctgataaatccactcttgtatattattcagcatatttctattcagttcatttttagaatagtttatctacagcagtaagtctatgtgaaatctaaaaatttgactaacttttattatatttcatttttacagtaggcagtggatagtcattttcactgctaaatctatgtaccaaatctactgagtattgcaaaaacacactggatagaatattatttgcaaagtgattcttgttgtcattcaccatagattcttttgggacaaaaaaattcttaaagataaaatgttgcctgtatttataaaaatcattgaggattcttcccaaaaatagaaatgagaaaatagaatttaaacaatcaaatgattaagtttgctctatagccaagtgttttggtctaagtgtctttggttgaaagcatctggataaaagcatagtgacaattttgaagcatgtcc

SEQ ID NO: 335191 - DNA, 852 bp, Homo sapiens
gcttgagtttctttaaaatacccagccctgaagaaaaataaaagccaaaataaagaaaaagaataagatcctaattaatgactgctggggagacctgcagacatatacagaatcgttgagaagtacatttgttcatggaccacaaatttggaccagttatctacagagcatgaaagtgatgctacaaacggaaaatgaaataatcagacagcaacctggacagcctctcggggacagacgctgggcaatggcagaacctcttctgctaaacaataggctatgatagtctacacggaaggggtgccactcagaaatatacgtagctcaaatattattcaaaccatctctaggataaagcagaaatactctatacagacatttcagcaatcacattctagtcctgcaaagagcaatatttacagaaatcagaaaatgttcttgttattgcacagccctcctgttttagaatgcctacagcaagaaatgatgctggactttgtaagagctccagcacgaagaccattccctaaaataaaggtctccttgctcacaaaggaagtaatagcagagaacagcagcttccatgtgacttaaaggatatttcaccttttgacactctggtaagattaattaagagaagaaccaaaagacatcattataaatatcagtacagcatatgagcttcagagtcagagaatttcagattgaatcctggctttaccatttaatagatgtctgatcttgggcaagttatttatcaagttatttagaataagtcttagttgttatctcatttatattcactaacttatcacatgtctatggagaagacagatcaaaaccaacattatt

SEQ ID NO: 335192 - DNA, 113 bp, Homo sapiens
gctggtctcaaactcctggcctcaagtgatccgcctgccttggcctcccaaagtgcttggatcacaggcatgagccaccgtacctggccaaagagaggattttgaatgttcac

SEQ ID NO: 335193 - DNA, 459 bp, Homo sapiens
caagcaggggagtcagctttggattaccttgaagcttgtgctcttttcacgaggatttatgtatttagccagtttcagaattcaaggtatagttgtttccagatgatgtgtcctctaatcctttattacataatgaagcctcagtgccttctgctagcgctctaggtacactggcttttagtgacagcatatagttgagggaacatgtggtttctgactttatgttttatatattatgatttcaagtttgttgtggtttgatttgaatttggaattgaaaatatattttagtatttgagctagaataaaaaaaaatttaaacagaaggaaaagtcaccacatttttatattttatcctctcaagtgaggaaattaaaagagagtattctcatggtaacaattttattgtatattgtgttccatcatgaataatgcattaatttagttattgcacttagt

SEQ ID NO: 335194 - DNA, 386 bp, Homo sapiens
cacctgtaaccctataaatgtctgtaaataaaacactaaaatttttaataaggatcccctaggttgaaatgggcacagaaatttttatcactggaataacctaattttgaaaacactgatggttagtttcttgaaatattaatattactacaagtcataagtaaaagcattctatcttaagtgagaaactacaaagttggataattactatttgagtttgtggcttggtttgaataaacacttgcttgttttaagtaaaagttcagctgaagtgacaatcaacctttaatcttgtaaagcttctgtgttagatattttctatctctaacatgccaaacatgcatattaaactgagtttttttgcatgcaatttctgtgcccatttc

SEQ ID NO: 335195 - DNA, 90 bp, Homo sapiens
tatggcatatgagctaatgaggaaagtcatcattcattgaatatttatcgagaaacccagagttcttccattttcccttattactggatt

SEQ ID NO: 335196 - DNA, 481 bp, Homo sapiens
gggtgggtaaagaagtgaaggaagggagaattccaggcataacaagaggccacaacctcaaggcagtcaagtaactaaagcctcgaagacttgatcacagctgcgattgtcacaacccagcaatgacaatcccagtccttatgagtatgaagtgctttcacatctattatttcacaacaatactgcaagataggcagatgtcactcttcccttcttttctagatgagtgatatagtttgggtatttgtccctgcctaaatctcaggttaaaaatgtaattgccaatgctggaggtgggacctgatgggaggtatctgtgtcatgagggcagacctctcatggtttggtgctgtcctcataacagtgagtgaggtcacatgagctctggttgtttgaaggtgtgtggcatcgcccctctctctctcccttgctcctgctatcaccatctgatgtgcctacccccgctttgccttctgccatg

SEQ ID NO: 335197 - DNA, 502 bp, Homo sapiens
ctagagtatccccgcctagcacgtgatttcatcaagtataggcattgcggatccatggcataacaagaggccacaacctcaaggcagtcaagtaactaaagcctcgaagacttgatcacagctgcgattgtcacaacccagcaatgacaatcccagtccttatgagtatgaagtgctttcacatctattatttcacaacaatactgcaagataggcagatgtcactcttcccttcttttctagatgagtgatatagtttgggtatttgtccctgcctaaatctcaggttaaaaatgtaattgccaatgctggaggtgggacctgatgggaggtatctgtgtcatgagggcagacctctcatggtttggtgctgtcctcataacagtgagtgaggtcacatgagctctggttgtttgaaggtgtgtggcatcgcccctctctctctcccttgctcctgctatcaccatctgatgtgcctacccccgctttgccttctgccatg

SEQ ID NO: 335198 - DNA, 330 bp, Homo sapiens
ttgtacttgtgcctgattgtataaaaatgaatgatgtagttctcgtcaaaagattaaaatataatgagcaaatgcaggattcaagatatatactaagtccataagaacacaaaagacaggcaccccaaccggcatctgcatttcagaatggtttctgcctttgagtcctgtatttggcaacagcaccttatgattttcttctttgttaaacagaatcctagggtgatgcatgatctgtgctgctatatcccatgcacaccagaatttcctcatataaaatgggggccatacataattttatgagctttcaagaggtaaagctgccagcac

SEQ ID NO: 335199 - DNA, 373 bp, Homo sapiens
gcccaggcttgacaggagcaaaagggtggtcaaataatataactaggcatcaagacatttaacagaaataaaggttaaaatgttatgaaaatgaaagactgaatttataaggaagacttaacaatcctaaatgtgtacacatgacagcttcaaaatactttaagcaaaaactgctcaagtagacagatctagaattacagctggagattttaacataactctcaatacattgtaggatgagtaaaaaatcagtaaggacacagaagatgtgcatagtcacaagctccaccagttgatctaactgacatctaaagaacactgaaccaccgggcaccacggctcacgcccgtaatcccagcactttgggaggccg

SEQ ID NO: 335200 - DNA, 243 bp, Homo sapiens
ctgcccagcactaagtgcacagaaagcttcttcctgactcatggtttttacatttgaaaaagggagattaaggtggacaactagcttccccaccaacttgggttccttggcaggagacctgtccctgcttcaaaccaaagaaagcatggcaagtgcctgaagggtgaaatatgcctgaggacagacagagacaaaggtggaaggtgggactatcattcccagctctgaaagctctgctctata

SEQ ID NO: 335201 - DNA, 318 bp, Homo sapiens
acttctcagaggatcccagtgtcatgaatacagggaagctctggcatctgaatgcattaaccttctgattaatgtcttagggaaactgagcttgcaaggttcctatcaaacttctttatttttctttttagttgactgatgggaaaggtgttggatacttagaaacagtttgacttctgaaacaaaaatatttagagctacttaagttgatccatgttagctctgggtggtcaactcacttagcaaaacttaacgctgatgatgaagcttctaaaatgttttcgtaggagctctggtgtaagtgtatacatgaacacg

SEQ ID NO: 335202 - DNA, 523 bp, Homo sapiens
ctccagcctgaacgacaaagcgagtcttttttcccccaaaaaaaaaaaaaaaaaaaaaaaaaaaaaaaaaaaaaaaaaaagcagctgaggacctagaaaccggcttttagaattgtttcccaactaggagtccataggccgtgagtgaggctcagggtctttgggtaaagggccgccgtggaagggctttctcactgggcgttgtggtctccagcctggctgctcaggggtgtttggttctgtttattctttagtctttgttcctgaaagttggccttgccagatgaatgacctggtaacttttgaagggactgttatttctgtgtgcaatggcgaggggaggttgagaagccgacaaggaagtcaagaagcttggggcggaggggggtcttcagatggctccagggtggccacacggacgaggctgcagaccagctgagttgtgtatcagggtagaactaggcccctagagtgacacagcacctggctcacttagaggagagttttctaacagccaagaggg

SEQ ID NO: 335203 - DNA, 399 bp, Homo sapiens
ttagggagcagctgtggaaggccagctgaaattttgagggccagaacccaggtagttgctaggcagcttgggaggaagttggtttcaggatatgtttaggaaagtagaatttcataactgatcaagagagtgggaagaggaggagtctaggttaatggtcaggttctggcttggctgcctaagtaggtgatgggtgtagtaactaagacaggaaatttagaaagcagacagtgttgggattaaagaggatgtgcttgaccctgcagaagttgagctggaggcacattcaggtgaagatacctagcagcactctgtggcactcatttggagacatggccatggatgagatctcctaagaagaatgtatatggaagaggaagagaagctaaggacagaatg

SEQ ID NO: 335204 - DNA, 636 bp, Homo sapiens
aaacagcttgaagttatttcatttcactgaggttgtacagggttcctgaaactgtcctgtttcaggagctgccagataacctgatcctagagtgaaactcacttggcattcagattttgtctatgttgatatacctcaacagtttaagattcttttttaacttacatggctccatgaaagagggatgtgatgtttcagtgttcagttttggtagctattaattatcccttgtagccttccacttagaagtgatactttcagattgaacattgtttcttaagttttttcctttccacccctctctcttcttcttcagaaataaagctctgcatgtgtgttggtgtgttttaagtataatttttaatctgtttgtggaaccacagaaatggatccaagaggtaggtaaggtcttaaattgaatttgatgttaaataagctggcctttgacccataggcaatgagtgaggagcaccgttgggtgtaagactagaagcagaaatactaggcattttagaggccaggtgaagggtgaataaggacatttaggtcaattgaaataaaaagaaaaagacagatgtgaaatgtagaaggacttaattatggtaggaacttagtgatttggagcctggcagcctg

SEQ ID NO: 335205 - DNA, 565 bp, Homo sapiens
tggtgcgatctcggctcactgcaacctccgcctcctgggttcaagcgattcccctgcctcagcctcccaagtagctgggattacaagcgcacaccaccatgcctggctaattttttgtatttcagtagagacggggtttcaccatgttggccaggatggtcttgatctcctgacctggtgatccgcccaccttggcctcccaaagtgctgggattacaggcgagaataataatttttaaaagcatgtgcagtgggaagaatggctcagaaaatctgcagctacaggtcttaagcttactggaaatctctgatcaacctggttaagtacagacaagcttaatggaataagaatcacggaaataatagttgaagctaacaagaaatatgtgcataatttacattgtacatacttggaatgtttaagaaattttgaccagttagaatgacacacttatacatcctattttaaataaatgattatttgacttagaattttaattgagtcttaattttacacagaatattggaatgtctaagacagctttagatttattatgtttgaagg

SEQ ID NO: 335206 - DNA, 265 bp, Homo sapiens
aaccactttcttctccttctaaaacccctttcctagccttcccactacacccatgcattcccttctctgtctctttccctatcttcactgcctcctctcatatattttctacaagctatctttctccttgggcatcgtaatgtcagtattcaccaaagtctcagctgctttttctctttacactttctctcctcttgctccttaaccccttgaacttcaactagatctctatacaggtgatttcctcttgttttcaccactccag

SEQ ID NO: 335207 - DNA, 845 bp, Homo sapiens
tttctcctaagtcccttatccggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 335208 - DNA, 1116 bp, Homo sapiens
  misc_feature (1013)..(1013): n is a, c, g, or t
  misc_feature (1059)..(1059): n is a, c, g, or t
  misc_feature (1066)..(1066): n is a, c, g, or t
  misc_feature (1068)..(1068): n is a, c, g, or t
  misc_feature (1070)..(1070): n is a, c, g, or t
  misc_feature (1078)..(1078): n is a, c, g, or t
  misc_feature (1081)..(1082): n is a, c, g, or t
tcttctctaccttgtcccaggtcttccaggatgggtgtctcctttgagaagcaggactgcttttataagagcgtttatgagccggctcgcctcacggctcgcctcacgtctcgcctcacggctcgcctcacgtctcccctgcctcgcctcacgtctcgcctgcctcgcctcacgtctcgcctgccccgtctgctggcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatccagcctgtgatgattgggtgcctttgccganagtcccgttctgtataaccgaaggaccggcaagtgtaaaattgggnactgttncntnctggaatnganntgatattggaaaagccccggggggccgaggacat

SEQ ID NO: 335209 - DNA, 551 bp, Homo sapiens
tggtaatcaataccactttctgtgggttgtcggtgaaactaggtggaatgttggcatgagtttatagctcatgaggaattctgtttcgaggtattgccccaactcagagttgcaacacacacaaaatgaaccacgttctttgtatgggcccaatgagctgtcaagctgccctgtgttcatttcatttggaattgccccctctggttcctctgtatactactgcttcatctctaaagacagctcatcctcctccttcacccctgaatttccagagcacttcatctgctccttcatcacaagtccagttttctgccactagtctgaatttcatgagaagatgccgatttggttcctgtgggtcctcagcactattcagtacagtgcttgatgcacagcaggcactcagaaaatactggaggaaataaaacaccaaagatatttgtctctagaggctcagctgacaaaatctgggagaagtttgcttttgtaactacaggcaggcttttttctccctgacatgaagagggagcagagaaggtcctgtagagaaa

SEQ ID NO: 335210 - DNA, 780 bp, Homo sapiens
tagtagagatagggtttcaccatgttggtctggctggtctcgaactcctgatctccagtgatctgcttgccttgatctcccaaagtgctgggattacaggcgtgagccaccacacctggtcttgtacctctctgttctatgcctgaacttccaccactgatcacttgccatcatcccagcaagtcacactgagcctgtgaaaccacagggcactggaaaccacacgttaggggaagtgggagagttggcggggctctcagatgaactccaaccccttgtttctcgcctggggaaagtgaggcccacaaaaatagagggacttggctcaagaacatgcagtgaatctgtggcagagccaggccctggccctctcttagggaggggtgcaaggggaaaggaaaaggaagactgggtcctggcccctggcttgctcacccaggctgcatctccccctgcaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggtaagtaggagaggtcctggcactgcccttggagggcccatgccctcctgcccagggagtcccagatggggtgggaggtaggggagacttatctgcctgttccagggtattacctctgacccagcccctcggagcccaaggaatgtgggcactggcctgac

SEQ ID NO: 335211 - DNA, 793 bp, Homo sapiens
tcctgccctgtgaacagcaggaagggtagggcaaggtgggatcacatctccaatgtgacaaacgaagctgttgccattttgctgacaagcaaatggaggataggggagaggtggtacatgggggacttagcctgctggaattcacagagcaaacaggcagatgggctggaatcagaagccagcggcttcagctccaaatccagggtgcttctcctatctatatctgtgctattcctaccaagtaatttgggccccctcgcataggagggctggttcctgggcctcccagtcagagagtctagaaccaccagaccctaggcatggctccaccagggaaatgagacccccaagaatccaaagcctctccctctctgagacctggctacagagagagaagatcatacttcccctctctccccaggaaatggcccggccagcccagtatcttgaagtcagctaggctggtttgggcacctaaggtcaggaattggccaagtttcctgggagaaagactggtgtggtgccaagagtcaggcaagatatctgaacacagaaacttgccagtccaggccctgccctgtagtaacctgctcccagacacgcctataacagtgtggtttgtttctccgcaaagctgacgggtcgcctcatgctggccgtgggaggagcagtgcttggctccctgcagtttggctacaacactggagtcatcaatgccccccagaaggtgagtactgtgccatcgttggcttatggacaccagcctgctctgttgcacatcacacatgcccac

SEQ ID NO: 335212 - DNA, 684 bp, Homo sapiens
tcctgccctgtgaacagcaggaagggtagggcaaggtgggatcacatctccaatgtgacaaacgaagctgttgccattttgctgacaagcaaatggaggataggggagaggtggtacatgggggacttagcctgctggaattcacagagcaaacaggcagatgggctggaatcagaagccagcggcttcagctccaaatccagggtgcttctcctatctatatctgtgctattcctaccaagtaatttgggccccctcgcataggagggctggttcctgggcctcccagtcagagagtctagaaccaccagaccctaggcatggctccaccagggaaatgagacccccaagaatccaaagcctctccctctctgagacctggctacagagagagaagatcatacttcccctctctccccaggaaatggcccggccagcccagtatcttgaagtcagctaggctggtttgggcacctaaggtcaggaattggccaagtttcctgggagaaagactggtgtggtgccaagagtcaggcaagatatctgaacacagaaacttgccagtccaggccctgccctgtagtaacctgctcccagacacgcctataacagtgtggtttgtttctccgcacaaaaaataatctcttataaatacacattttggccgctttggccaattcgatt

SEQ ID NO: 335213 - DNA, 2630 bp, Homo sapiens
agccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 335214 - DNA, 3518 bp, Homo sapiens
agccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatgcattattttgaatgtgaagtaaatactgtacctttatttgacaggctcaaagaggttatgtgcctgaagtcgcacagtgaataagctaaaacacctgcttttaacaatggtaccatacaaccactactccattaactccacccacctcctgcacccctccccacacacacaaaatgaaccacgttctttgtatgggcccaatgagctgtcaagctgccctgtgttcatttcatttggaattgccccctctggttcctctgtatactactgcttcatctctaaagacagctcatcctcctccttcacccctgaatttccagagcacttcatctgctccttcatcacaagtccagttttctgccactagtctgaatttcatgagaagatgccgatttggttcctgtgggtcctcagcactattcagtacagtgcttgatgcacagcaggcactcagaaaatactggaggaaataaaacaccaaagatatttgtctctagaggctcagctgacaaaatctgggagaagtttgcttttgtaactacaggcaggcttttttctccctgacatgaagagggagcagagaaggtcctgtagagaaa

SEQ ID NO: 335215 - DNA, 3249 bp, Homo sapiens
  misc_feature (3249)..(3249): n is a, c, g, or t
agccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccgctacaaaagatactaccctcgagggggcgcggaccagaatagtgagcgggcgcccccccggtttttttttgttaggaagagagggcgcgcccccatatagagggtggcggatctatataatatgtaaacgagcaagaggcgacgcgggcgactcagtttaataaaacaacggtgtcggtggaggaggaaaacaaaggtgcgaggtagcaggaggagctatttgggaggagaagacacccccctactatcgtcggggggggaggagagaacaatcgtgggggaacccaccaccctaccaccaagaagattatattatacacgccccctcgcgagaggggaaatataaacacaacgttgtcgaacagccgtgttatgtgggtgggcggtggaaacaaaaccacgtaaggatatattactgtcgtgcgtgcgcgagagaaaaatagcttgtgcgtaccacggacagtgtagattcatcagagaacaaaatcttttccccgggggcgcgttcatgaataaatagagagn

SEQ ID NO: 335216 - DNA, 2548 bp, Homo sapiens
agccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagta

SEQ ID NO: 335217 - DNA, 2291 bp, Homo sapiens
agccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 335218 - DNA, 2977 bp, Homo sapiens
tcctgccctgtgaacagcaggaagggtagggcaaggtgggatcacatctccaatgtgacaaacgaagctgttgccattttgctgacaagcaaatggaggataggggagaggtggtacatgggggacttagcctgctggaattcacagagcaaacaggcagatgggctggaatcagaagccagcggcttcagctccaaatccagggtgcttctcctatctatatctgtgctattcctaccaagtaatttgggccccctcgcataggagggctggttcctgggcctcccagtcagagagtctagaaccaccagaccctaggcatggctccaccagggaaatgagacccccaagaatccaaagcctctccctctctgagacctggctacagagagagaagatcatacttcccctctctccccaggaaatggcccggccagcccagtatcttgaagtcagctaggctggtttgggcacctaaggtcaggaattggccaagtttcctgggagaaagactggtgtggtgccaagagtcaggcaagatatctgaacacagaaacttgccagtccaggccctgccctgtagtaacctgctcccagacacgcctataacagtgtggtttgtttctccgcaaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 335219 - DNA, 2708 bp, Homo sapiens
tagtagagatagggtttcaccatgttggtctggctggtctcgaactcctgatctccagtgatctgcttgccttgatctcccaaagtgctgggattacaggcgtgagccaccacacctggtcttgtacctctctgttctatgcctgaacttccaccactgatcacttgccatcatcccagcaagtcacactgagcctgtgaaaccacagggcactggaaaccacacgttaggggaagtgggagagttggcggggctctcagatgaactccaaccccttgtttctcgcctggggaaagtgaggcccacaaaaatagagggacttggctcaagaacatgcagtgaatctgtggcagagccaggccctggccctctcttagggaggggtgcaaggggaaaggaaaaggaagactgggtcctggcccctggcttgctcacccaggctgcatctccccctgcaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 335220 - DNA, 2149 bp, Homo sapiens
agccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 335221 - DNA, 1499 bp, Homo sapiens
tggcgactctagacggacccctcagctggaccaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 335222 - DNA, 3524 bp, Homo sapiens
  misc_feature (2003)..(2003): n is a, c, g, or t
  misc_feature (2025)..(2026): n is a, c, g, or t
  misc_feature (2041)..(2041): n is a, c, g, or t
  misc_feature (2043)..(2044): n is a, c, g, or t
  misc_feature (2047)..(2048): n is a, c, g, or t
  misc_feature (2050)..(2050): n is a, c, g, or t
  misc_feature (2059)..(2059): n is a, c, g, or t
  misc_feature (2062)..(2063): n is a, c, g, or t
  misc_feature (2067)..(2068): n is a, c, g, or t
  misc_feature (2074)..(2074): n is a, c, g, or t
  misc_feature (2083)..(2083): n is a, c, g, or t
  misc_feature (2094)..(2095): n is a, c, g, or t
  misc_feature (2100)..(2100): n is a, c, g, or t
  misc_feature (2102)..(2102): n is a, c, g, or t
  misc_feature (2106)..(2106): n is a, c, g, or t
  misc_feature (2109)..(2109): n is a, c, g, or t
  misc_feature (2113)..(2113): n is a, c, g, or t
  misc_feature (2123)..(2125): n is a, c, g, or t
  misc_feature (2136)..(2136): n is a, c, g, or t
  misc_feature (2147)..(2148): n is a, c, g, or t
  misc_feature (2152)..(2152): n is a, c, g, or t
  misc_feature (2156)..(2156): n is a, c, g, or t
  misc_feature (2163)..(2163): n is a, c, g, or t
  misc_feature (2165)..(2165): n is a, c, g, or t
  misc_feature (2172)..(2172): n is a, c, g, or t
  misc_feature (2174)..(2174): n is a, c, g, or t
  misc_feature (2181)..(2182): n is a, c, g, or t
  misc_feature (2184)..(2184): n is a, c, g, or t
  misc_feature (2186)..(2186): n is a, c, g, or t
  misc_feature (2196)..(2198): n is a, c, g, or t
  misc_feature (2203)..(2204): n is a, c, g, or t
  misc_feature (2211)..(2213): n is a, c, g, or t
  misc_feature (2216)..(2216): n is a, c, g, or t
  misc_feature (2218)..(2218): n is a, c, g, or t
  misc_feature (2220)..(2221): n is a, c, g, or t
  misc_feature (2223)..(2223): n is a, c, g, or t
  misc_feature (2225)..(2225): n is a, c, g, or t
  misc_feature (2232)..(2234): n is a, c, g, or t
  misc_feature (2237)..(2237): n is a, c, g, or t
agccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttgtgtatttattcttttgtntgttgttgtttttgttcaagtnngagaatctcaaaaantnnatnnantaaaaatcntgnntganngcaatntggggcctnaatttcaaatnnacttnanattnaangagnaaaaaacagnnnatctccccatnctaatttttannttcntatntattttntnaatggcntnttttttnntnanataaatcccnnnccatnnctaaaannngtntnanncnangtttttnnntantctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatgcattattttgaatgtgaagtaaatactgtacctttatttgacaggctcaaagaggttatgtgcctgaagtcgcacagtgaataagctaaaacacctgcttttaacaatggtaccatacaaccactactccattaactccacccacctcctgcacccctccccacacacacaaaatgaaccacgttctttgtatgggcccaatgagctgtcaagctgccctgtgttcatttcatttggaattgccccctctggttcctctgtatactactgcttcatctctaaagacagctcatcctcctccttcacccctgaatttccagagcacttcatctgctccttcatcacaagtccagttttctgccactagtctgaatttcatgagaagatgccgatttggttcctgtgggtcctcagcactattcagtacagtgcttgatgcacagcaggcactcagaaaatactggaggaaataaaacaccaaagatatttgtctctagaggctcagctgacaaaatctgggagaagtttgcttttgtaactacaggcaggcttttttctccctgacatgaagagggagcagagaaggtcctgtagagaaa

SEQ ID NO: 335223 - DNA, 1606 bp, Homo sapiens
agccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccagggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 335224 - DNA, 1870 bp, Homo sapiens
agccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacaccagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 335225 - DNA, 1920 bp, Homo sapiens
agccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgtgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 335226 - DNA, 985 bp, Homo sapiens
  misc_feature (882)..(882): n is a, c, g, or t
  misc_feature (928)..(928): n is a, c, g, or t
  misc_feature (935)..(935): n is a, c, g, or t
  misc_feature (937)..(937): n is a, c, g, or t
  misc_feature (939)..(939): n is a, c, g, or t
  misc_feature (947)..(947): n is a, c, g, or t
  misc_feature (950)..(951): n is a, c, g, or t
agccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatccagcctgtgatgattgggtgcctttgccganagtcccgttctgtataaccgaaggaccggcaagtgtaaaattgggnactgttncntnctggaatnganntgatattggaaaagccccggggggccgaggacat

SEQ ID NO: 335227 - DNA, 888 bp, Homo sapiens
  misc_feature (789)..(789): n is a, c, g, or t
  misc_feature (870)..(870): n is a, c, g, or t
  misc_feature (884)..(884): n is a, c, g, or t
agccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccagagtgttncggcctgggacttccattcattggggccaacaaagggaccttgtgggccccttgcttgcttgaaccattaatctttcattncccaaaccccttgnttgg

SEQ ID NO: 335228 - DNA, 793 bp, Homo sapiens
agccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaatcccaaacttgaaacaacagatacgcctctgccgaagaagtttccctttagaccccaagcccgtaaggtcactgcagtgcagtgtcccttctgcctgagtatttgtccccttcattctttactcatcctgggtcccacatccactgctacagaggcagggaagggccacaatgtcca

SEQ ID NO: 335229 - DNA, 1517 bp, Homo sapiens
tctgaggcaatctagaggatcccttggtcatacaggtgggtgccagccagaacaagaggcgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatgcattattttgaatgtgaagtaaatactgtacctttatttgacaggctcaaagaggttatgtgcctgaagtcgcacagtgaataagctaaaacacctgcttttaacaatggtaccatacaaccactactccattaactccacccacctcctgcacccctccccacacacacaaaatgaaccacgttctttgtatgggcccaatgagctgtcaagctgccctgtgttcatttcatttggaattgccccctctggttcctctgtatactactgcttcatctctaaagacagctcatcctcctccttcacccctgaatttccagagcacttcatctgctccttcatcacaagtccagttttctgccactagtctgaatttcatgagaagatgccgatttggttcctgtgggtcctcagcactattcagtacagtgcttgatgcacagcaggcactcagaaaatactggaggaaataaaacaccaaagatatttgtctctagaggctcagctgacaaaatctgggagaagtttgcttttgtaactacaggcaggcttttttctccctgacatgaagagggagcagagaaggtcctgtagagaaa

SEQ ID NO: 335230 - DNA, 1161 bp, Homo sapiens
  misc_feature (2)..(2): n is a, c, g, or t
  misc_feature (7)..(7): n is a, c, g, or t
  misc_feature (9)..(9): n is a, c, g, or t
  misc_feature (17)..(17): n is a, c, g, or t
  misc_feature (19)..(19): n is a, c, g, or t
  misc_feature (21)..(21): n is a, c, g, or t
  misc_feature (47)..(47): n is a, c, g, or t
  misc_feature (66)..(66): n is a, c, g, or t
  misc_feature (68)..(68): n is a, c, g, or t
  misc_feature (76)..(76): n is a, c, g, or t
cngtctngngtgccggntntngtggggttgggagggagggcgggggnagtggcgtgagaggagggngngtgggggnggggggggtcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatgcattattttgaatgtgaagtaaatactgtacctttatttgacaggctcaaagaggttatgtgcctgaagtcgcacagtgaataagctaaaacacctgcttttaacaatggtaccatacaaccactactccattaactccacccacctcctgcacccctccccacacacacaaaatgaaccacgttctttgtatgggcccaatgagctgtcaagctgccctgtgttcatttcatttggaattgccccctctggttcctctgtatactactgcttcatctctaaagacagctcatcctcctccttcacccctgaatttccagagcacttcatctgctccttcatcacaagtccagttttctgccactagtctgaatttcatgagaagatgccgatttggttcctgtgggtcctcagcactattcagtacagtgcttgatgcacagcaggcactcagaaaatactggaggaaataaaacaccaaagatatttgtctctagaggctcagctgacaaaatctgggagaagtttgcttttgtaactacaggcaggcttttttctccctgacatgaagagggagcagagaaggtcctgtagagaaa

SEQ ID NO: 335231 - DNA, 446 bp, Homo sapiens
agccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgagtactgtgccatcgttggcttatggacaccagcctgctctgttgcacatcacacatgcccac

SEQ ID NO: 335232 - DNA, 228 bp, Homo sapiens
gtatgccaccattggctccggtatcgtcaacacggccttcactgtcgtgtcggtgagtctttgcttactggcccccccagccaaaccccagggaggaggcagtgccatcttccccactggtctttgcagtgccctgtgactttctcagctcttgaggcaaggcctctgggtgggtgggttcagaagggcactaggcaggggtggcactgacactgtctctgcccacag

SEQ ID NO: 335233 - DNA, 426 bp, Homo sapiens
cttctccaactggacctcaaatttcattgtgggcatgtgcttccagtatgtggaggtgagaacccccactgtctctatactcaccatttctcacccgcacgcatgaccccacagtgctgtgcaaagtgctggcccagcattctcattaggaatcatgctgaggaggaaactgagggtaggaagcccaggtcacatgaccaagaatgctgacctcaactccagggttctccccttagccttgaatggtgctcctggagcctgttacattctaggtacaagcgtggtctcagttaattatgatagcatccctgggtaggtggatgttcccttttcagctcaaaggcccaaaggtaaagtgacttatccaaagtcctacagccaggatgtagggtcatgactccaaccaagtgtgtctgtgtgtctttc

SEQ ID NO: 335234 - DNA, 230 bp, Homo sapiens
cagccaagccctctggtcaagtgtgcatggtgaacaagtcccaaacttgaaacaacagatacgcctctgccgaagaagtttccctttagaccccaagcccgtaaggtcactgcagtgcagtgtcccttctgcctgagtatttgtccccttcattctttactcatcctgggtcccacatccactgctacagaggcagggaagggccacaatgtccaggtaggccccaacag

SEQ ID NO: 335235 - DNA, 510 bp, Homo sapiens
gtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccagggtaagctggggcaggatctacctgcctggcacggcccctgcccacagcttcagtggctctcggatctgtgcccagcagggcagagtttctcttccgcccagcccccacagccttgcagaggacaactatggtacacaggtccagagaacacagcaccatggcctcccagttgacagcaagatgacttgactcttctcagtccctttcttctcactctaggcttccaaccacagggcccgccttcccccaacatgccgcaggctgttatgcacagtaccctctctccaggaggcttccccttccct

SEQ ID NO: 335236 - DNA, 573 bp, Homo sapiens
  misc_feature (1)..(1): n is a, c, g, or t
  misc_feature (23)..(23): n is a, c, g, or t
  misc_feature (30)..(30): n is a, c, g, or t
  misc_feature (61)..(61): n is a, c, g, or t
  misc_feature (90)..(90): n is a, c, g, or t
ntaggatttggcccttcccaatnttttccntacccaaccacttcaaattaatcctttcttnacctgagcccagtcgccagatgatgcggnagaagaaggtcaccatcctgaagcttgttccggttcccccgcctaccgccagcccatcctcatcaaccgcaacgaggagaaccgggccaagagtgtgctaaagaagctgcgcgggacagctgacgtgacccatgacctgcaggagatgaaggaagagagtcggcagatgatgcgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 335237 - DNA, 2620 bp, Homo sapiens
  misc_feature (33)..(33): n is a, c, g, or t
tgtcttttcgggcgtattttttcctcccgccgncccggccggaattcccgggatgcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 335238 - DNA, 2761 bp, Homo sapiens
tcttctctaccttgtcccaggtcttccaggatgggtgtctcctttgagaagcaggactgcttttataagagcgtttatgagccggctcgcctcacggctcgcctcacgtctcgcctcacggctcgcctcacgtctcccctgcctcgcctcacgtctcgcctgcctcgcctcacgtctcgcctgccccgtctgctggcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 335239 - DNA, 2735 bp, Homo sapiens
tcttctctaccttgtcccaggtcttccaggatgggtgtctcctttgagaagcaggactgcttttataagagcgtttatgagccggctcgcctcacggctcgcctcacgtctcgcctcacggctcgcctcacgtctcccctgcctcgcctcacgtctcgcctgcctcgcctcacgtctcgcctgccccgtctgctggcaacagcgagcgtgccggtcgctagtcgcgggtccccgagtgagcacgccaggggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 335240 - DNA, 2534 bp, Homo sapiens
agccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 335241 - DNA, 2100 bp, Homo sapiens
agccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 335242 - DNA, 2272 bp, Homo sapiens
agccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 335243 - DNA, 1297 bp, Homo sapiens
gtcatcttcacctacttcaaagttcctgagactaaaggccggaccttcgatgagatcgcttccggcttccggcaggggggagccagccaaagtgacaagacaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 335244 - DNA, 737 bp, Homo sapiens
agccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgctggagcccctcccggccccccacagagaggcgtcggtaccgagctgatta

SEQ ID NO: 335245 - DNA, 332 bp, Homo sapiens
acaacataaccctatctcccacaagataaaatgcttaagtagacatgcagcatgcaatacaggtgttagataatgtctccttaccctgtgttagacatcactcaggcccagaggcaaattccatttcttgaattattctacagtaaaccaggctgtcttttgagacagggtctctctctctcacccaggctggagtgcagtgacacaattacagctcactgcagcctcgacctcctggactcaagagatcctcccacctcagcctcctgagtggctgggaccacaggtgcatgcaactacgcccagctaatttttgtatttttttgttgaga

SEQ ID NO: 335246 - DNA, 270 bp, Homo sapiens
aggctcctcccaacccaggattcctgagacataccccagtagggtgagctgaatgccctcaggaaactgaaagtgcttaaaggagcgcttgaggaacaaataccccaaagcccaaagagaagtggcttggggaagtgtcggtgtggctcttctccagctctgcaatgatcagtgggaccaagggccaaggagaaggagatgcccaaagagagggaataggatagcgttcccagcagctttctctcaaaggacctggtttagggggtaggg

SEQ ID NO: 335247 - DNA, 1040 bp, Homo sapiens
agagccaagaagataatcaacaatcaaaaggtgatacgattatttcaagttcccctctttagagttcatggctgttgctgatgatgctggtgccagagtagtgttttaaccttagcgctctcccatggtaaccacaaaggcagcaggagggcaggtgggaggttccagagttgtcagcacgttggtgaaatgcctgccctcattttaacgacgccgtggatgtttgtgtttgccttccgttggctgtttcaaacttaactttctagtttgacaatcatattttaccttcagtgattcttttgtttcagaactgattgtgtcctctaatagctaactaatatttttgtatattttgattatttctagtaatttttgttaattttattcatatatacacaatttggaaaatcctcttgctgtagttatgaatactttttatagatgctaagattttaaaattgctggaatagataataaatttgcaattttatttttaaatgacttaccttttttcccctactgtgtcaggaaccttaaaggcggtgtttcaaggttggtgggtctcataactgctttgcttgcttttccctgaaaggggtctgtcttttcacgggagtttctctaacgtgctttgcagagtgatgcttgccttactgcaggccgctgattgttttgctaatgctttttatctttgctttgggaaactgcagatctgaagctgtcttatttatggcaacttctgtttgaggccctaatgcttatgttggtgtggaacatcaaaagaatgcttcttaacccattttcaagccccaaaaagttgatatttcactagaccttagcttttcagctgttggagaagtatgcgtttttccagaaccattgtccattcactttagtgctactcaaaagagctgctcccagaaagctctggaggataaaaacagggcttccttatctggggatttgctgttaggctgacagtgaccagctggtgacaagtgtgacgccgggcacagcagtcctgtgaggctggtctggtg

SEQ ID NO: 335248 - DNA, 849 bp, Homo sapiens
gtgtgctggtaacaaacattcatttgaggagttttagaaacacaatcccaaataagcacctttgtccttttaatgagctgaggcccaagtgcccatactcgggttctccctgcagtacagcaggttctttcatacatctcagtgaagcacacaggacccccatactgcggctgtgacagcagggggtgacatcagtcacctggctaggccctggagaaaagcctgcacagcactccctccaccagcctctcatggtccccgagtcccgggcatcctgcagctcactccagtcggcttatctccctgacctttggccactctcatgctgaggtcacctatgaccctgatattcctggttctggagagcgcacctctaccacatccatgggcagcactgggcacagctgtccgtgctcccatagcgcgatggcctccaagccacctgtgattccaccctcggaggttggctccttctcaacctccttagccagctgcagcgtgtctgcggggactttaaatgttggcatccctcccagaccaatcctgtgccctcctttctcctcccacactctctgttgggatctcatccttgccccaatgccatcatgtgcctggctcccaagggcccccttccagcccagatctctcttctgagttccaggtccagatctcaaacacctcagactcagcatgtccaaaactgaagccttagtccctcaccggtctgctcctgtaatgggccccaccccagtggccagcatcatctccgtcaccgcttgtccttgacaccccctcacttctcatatccaagcagtgatcgtgcctttggactctctgcacaacgtgtcc

SEQ ID NO: 335249 - DNA, 215 bp, Homo sapiens
catttggtcattcacagaaaaagtttgccaacccttgacttagaagaatctctagatgagtggtcttcaaccgaagtactaaaggcatttaggatgaaacaagtcttcattgtatagggttgtcccttgctgtgcgggatagtcagcgtttttagtccccaacaggacctagcaccctaatcattatgactgaaaaatcttgttccaaacactct

SEQ ID NO: 335250 - DNA, 149 bp, Homo sapiens
gatgctctcatcaaagagtttcagacttttgatggaaacagctgaaacttttaaagtaatttacattcactgttttgacttgggctgtatgtgaagagggttcctctggccgggcaacagtcccgtcagctatctcttttttttttttt

SEQ ID NO: 335251 - DNA, 154 bp, Homo sapiens
ctggagagtgtcttcgtttgggcaccttgatgctgcagggacctcagcggtgggtggcaggcagcacccacaggagagggaggctggtgggtggtagagcccacacccagaggacacatcctcaattccattttttttttagagatagggtctt

SEQ ID NO: 335252 - DNA, 170 bp, Homo sapiens
acctatacatgcacatgcccatcacatagcctggtcagaaaagagctctggggctctcagggctgcacgtcctgtaacatcactgatgaggctgttttgtcataaaataaaaggcacccaaatcagtaggtaaatacatgactaagtgaggggagggtggttgggagttg

SEQ ID NO: 335253 - DNA, 389 bp, Homo sapiens
atgcgtgtgccaccacacccagattttttttgtattttaacagaggtaggtcatcaccaggttgcccaggctgatctcgaactcctgagctcagacaatcctccttccttggcttctcaaagtgctaggattatagatgtgagccacagtgcctggccctgtggcgttgttatctttactttatagatgaaaatgttgaagtctaaaggttaagtaacatgcaaaatcacgtagtgcctcagcacagctgaaaccccttttctttgccttttcccacagcatctccctctagtaacggatttcactagcttcttcgtaaaagtagtcccaatattggcttcttttccacgtatgtgtgtaatctgtcacattttgaaaatattatcagc

SEQ ID NO: 335254 - DNA, 455 bp, Homo sapiens
tcttgaactcttaggtcatgagtacaaatagaagtcccttctcttagaaatcagaggccttgctcacgcctgtaatcccagcactttgggaggccaaggtgggcgcatcacaaggtcaggagttcaagaccagcctgaccaatatggtgaaaccccatctgtactaaaaatacaaaaatgctgggcgctgtggcgcatgtctgtaatcccagcactttgggaggccgaggtgggtggatcacctgatgtcaggagtcgagaccagcctggccaacatggcgaaatcttgtctctactaaaaataacaaaatttagttgggcgtggtgggtgcctgtagtcccagctacccaggaggctgaggcatgggaatcgcttgaacccaggaggcagaggttgcagtgagccgagatcgcactattccactccagcctgggcgacagggagactccatctc

SEQ ID NO: 335255 - DNA, 456 bp, Homo sapiens
taaattggcctgagagtcaggcgactggagttctaattctaatccttagacgcttgagcatagatgaatttcctttgcgtcttactttttgtgttaaatgtgagtaatggctttctcttgctataattctggggttattagggttaaagagagacacatgttagaagtctttgtacattgttgttacttcgtgcgctgtggcttaattttgtctttgttattgggggaaatctctgaatgagtcaagtttacactaatgtcaatttggaggtgtaaaaaataaagtgggacttaaaaaatattcaaacattaattgaatgcctgcttacctaagactattacttgacattgacttatcaatgtgtgtctaatgaaatccttaagaatggaattaggcagctgggccttagggaaaccagtatttccgaaactatcacctattgtctctactgtctt

SEQ ID NO: 335256 - DNA, 435 bp, Homo sapiens
gttcctgaagagcagtttggggctctccccaacaaagatatcattctctacctacatgctttatctgcaatgtaacgatgccatgctctaaagacggttctgtatcccaatcgattcaactaatctaatatgaagcttttctccatgacactaactaccatataatcttccactgtaagactgagtcctgatttataaaactacactcttactattggatgtgtcctaaactctttttcaaaaatgatctgtgatgcacagaagaatgaaagggtgggctggtcagtttggttgatttagaagataatcctaatcatgtctgtgtagagaagtcataggtcttcttgcctaaactctggttgaccacctgacagatgctgtcaaaatagagacgatgacacagatgacgggattaactcaactctgtgtctagga

SEQ ID NO: 335257 - DNA, 766 bp, Homo sapiens
tgagaccctgtctcaaaaaaaaaaagtgtgccttcaatagaaggcttgaacgtattttatgggatttggtttagctgaaaaaaacagtgagaagcagattaagctggtaatttctgacaaaaagtatctaaaagatgaagtgaagaatgttaaacatcaagtattatattacagttgctcttagactagtagcttttagtttataacatgtcatttgtttgctctgaagattaagcaagttcatacttcttggaagttaaatttgacttttccagaagcactggattatttacgaaataaaaaatataattgataactttaaactactatttcaggtagtctattactagtaaatgtatgattctacatttaaatttcaggtaaatctttgttagtaacctactgcctaaaaaaatgttacatgagggagtacttttgtttgcatgttaggatcataataggccatacataataatcttgagcttgggaggagcttgttagccaaacagcatgccttaatgttgacttgcagaagacaattttaaatattgcctttgaaaggcagtggataatgtgacagtgagggggtttatgaaaccataaaattgagctttttgacttagtttttgtttttaagttgttcagatcttgggagtcatttcttcaaaacaaatgactatgaggtggaaaattacttaccttgaataaattaattggaaaatcagagaacactgggtttatttaggatgaggttgtttggtatgtg

SEQ ID NO: 335258 - DNA, 1125 bp, Homo sapiens
  misc_feature (77)..(77): n is a, c, g, or t
  misc_feature (87)..(87): n is a, c, g, or t
  misc_feature (98)..(98): n is a, c, g, or t
  misc_feature (109)..(109): n is a, c, g, or t
  misc_feature (165)..(165): n is a, c, g, or t
aggatccccctggattatagtaggagttttagttttggttttggtttagtttttgctaactagcagtctaggtttcnaccaggcagncgggctctaangttcttagaanatgtttgcatgctgtactatgcttctcccacaggatactaacttaaactgtggtgnagcatgtcattatttaatgttttgaaatctgtaaatttatttctaaaaaaaaattaaaatctcaaatttttatatttgaggttctttcactgaaggatgttgatctgctcaatataagtagagggcaagattttgaaaaggagcagtgcaagtaattatacccacagcgcataactaattttacagatctgtcatagaggcttatactttgtaccactcattaaatggaatatagaaccttgagatctgaaagaatgtccagggatttaaatatttagggatgtgtggtttggaaaacactttgtctgtgggcttaattttgtaaatcaaccaaactctaacctacgatgtagcatgtgtattataagaagtgtgaaatgtcatcaataatcagcatagtagtttcctagaacttgactggcagaaaactttctttgatagtatcagtgggtgctcacccattagataactaaaagatgtgtattcacgtgctaatgaattaaaactgattgctatttgttcatatgtcctcacaaatttagcaagacaggcatggaggtgaaaaaaatagtaacaactagatgagggaaagattgtatacactgaagaaaagttgagaggagaatactaaagggaaatatggtttcccttccctccttttaagttacttatatatatagttatatataatccttactgtcccatgactttcaccaaagatggagtgactaggcctgactgatatgtagaagaaaagttgtgatctttccttgaaaccaggaccctatcatctgacttaccaagattcataaatactgtataactccagaagattagaacataatgttaaatcacattagtccttacaaacttgttttttctacctttgaaattgccacttatacattagttttttgaacattacaattgatcaggatatataagctatgagacttatga

SEQ ID NO: 335259 - DNA, 2766 bp, Homo sapiens
gtcataggaaatatttttttcacaagtggtacccaagtgtattttagtgtaaatcaactagtgcttgtaggctcacctgttgtatctttttatttttcgtcttttagtttttataggatgagataattgtctttatttgtaattggttaaagaattagaacaatgcgagaagcttgtctggagatgccctttttaaaatcgtttctggccgggcgcagtggctcacgcctgtaatccaacaatttttgggaggctgaggcgggtggattacttgaggttaggagttcgagactagcctgcccaacgtggtgaaaccctgtctctactaaaaatacaaaattagccgggcgtggtggcgtgcgcctgtgatcacagctacttaggaggctgaggcaggagaattacttgaacctgggaggcggaattgcgccacgacactccagtctaggcaacagaatgagactcttgtctcaaaaataagtaaatacgtaggtccataaaagcaattttaagtggagatgtcctttggagctgggagtgaaggtagcacttaagcggtggctttgcatgtcttgataaaagtaatgagttgtttgcctcaatacagcttcaactaaaattcggattttgagctcaaaaaatgttaatgcccttcatagaaattaaggggaatggaaatcttttcttaacattttacacctctacccctaaaattttaagaactgtactttataaaaatgtgcaattttcatacagcatcccagtgttgatcatggaggttaatgattctttattgttagggacctatcttgtaattccagagttatttatgttttctacagttgaagaggaaaaataccgcttcttattgcctccttttcaggatttcttctggcttcttgagtagctggagtatttttgagagactcctacaggccctgcggggtggcacatgcctgtaatcctagctacttaggaggctgaggtgggagaattgcttaaacccgggaggcagaggttgcagtgagccgagatcgcatcactgcactccagcctgggcgacagagcaagactctgtctcgaaaaaaaaaaaggcaaacaaatttatctgtatcaatttggaattaaaagatttgtgtgtatagattttttgttaaaaatagaagaaatagggggagggtccttttctgaaatctgagaatgatagggatgatgactatcaaaacccaggcctgtgactggcttgtttaaaaacaaaacaaggccggcccggtggctcacgcctgtaatcccagcgctttgggaggctgaggcgggcggatcacaaggtcaagagatggagaccatcctggccaatatggtgaaatacagtctctactaaaaatacaaaaattagctgggcgtggtggcgcgcgtctgtagtcccagctactcgggagggtgaggcagagaatcacttgaacccgggaggcggaggttgcagtgagccgaggtcggccactgcactccagcctggcaatagagcgagactcgtctcaaaaacaaaacaaaaaaaaacacagaacttttaaattgggcttaaaatttttttgtgtatgaagttttaagataaatgtgagagatgtcatagcattttgcttattcagcgtctttagcaatttaattccatatatcatcaaattgaccttacataagggtaaagctttctttcttatagtagggatagtgttaacctaagagagtcttgggtttaatctattttcctaaatttaagtactatcatttatctgattttaatgctttcagttgttctcctctccccttccatttaagcaaagaatttgtaaactaaaaaaaaattaaaatctcaaatttttatatttgaggttctttcactgaaggatgttgatctgctcaatataagtagagggcaagattttgaaaaggagcagtgcaagtaattatacccacagcgcataactaattttacagatctgtcatagaggcttatactttgtaccactcattaaatggaatatagaaccttgagatctgaaagaatgtccagggatttaaatatttagggatgtgtggtttggaaaacactttgtctgtgggcttaattttgtaaatcaaccaaactctaacctacgatgtagcatgtgtattataagaagtgtgaaatgtcatcaataatcagcatagtagtttcctagaacttgactggcagaaaactttctttgatagtatcagtgggtgctcacccattagataactaaaagatgtgtattcacgtgctaatgaattaaaactgattgctatttgttcatatgtcctcacaaatttagcaagacaggcatggaggtgaaaaaaatagtaacaactagatgagggaaagattgtatacactgaagaaaagttgagaggagaatactaaagggaaatatggtttcccttccctccttttaagttacttatatatatagttatatataatccttactgtcccatgactttcaccaaagatggagtgactaggcctgactgatatgtagaagaaaagttgtgatctttccttgaaaccaggaccctatcatctgacttaccaagattcataaatactgtataactccagaagattagaacataatgttaaatcacattagtccttacaaacttgttttttctacctttgaaattgccacttatacattagttttttgaacattacaattgatcaggatatataagctatgagacttatga

SEQ ID NO: 335260 - DNA, 376 bp, Homo sapiens
tcccagataattttttgtatttttagtagagacagggtttcaccgtgttgaccagtctggtctcgaactcctgacctcagatgatccacccatcttggcctcccaaagtgctggaattacaggcatgagtcaccgtgcccagtctagtattttttttttctcattcatttctcaggtcccacagttcacttatttcatagtgttgcacctgagcttcatattattacacgggaaattgagcgctcatttgcagggcatggctactcaacctgcttgcgttgtgccacagggacttaaagggctcagtgatgactttgtgttgcttctttgataggctgcttggtgagggggtgttaaggctccttcaagtgtgggg

SEQ ID NO: 335261 - DNA, 846 bp, Homo sapiens
gatgaaggacccgacttttgccaccttcatgtatgaactgtgctgtgggaagcagacagccttcttctcatcccagggccaggagtacaccgtggtgttttgggatggaaaagaggagtccaggaactacacggtggtgaacacagagaagggcctcatggaggtgcagaggatgtgctgccctgggatgaaggtgagctgccagctccaggtccagagatccctgtggacagccaccgaggaccagaaaatctacatctacaccctcaagggcatgtgcccgttaaacacaccccaacaggccttggatactccagctgtcgtcacctgcttcttggccgtgcctgttattaaaaaggtgaggtcggggcaaaggcaggtatgcaggtctctgatgcacttccacgcctaggaggcgtctcctagctatgtcagggtggcgcctgcagagccacacctaggaccacctggcctaggacgtagacttagagacggtgggaggaaagatatcagacctggtccgtcattagtgccttccggtttgcaaaaacctaagtcaagtccccagccagactgcaggccgaatgaaaaaccccctttcacatgcaaatgccctgactcaggtggaaggactgttggtacaaatggcacggtgagcagtcatgcgtgtgcccttcccctatccggagcctcttccccacctgcccaggccagagccacctcacagccacttgatcaccaggtcctggaggtcctgatctccctccctccatctctgcctcccgccaagtactcgccgtcttacaccagacgcagtttctctttgtgcagcatagccctgcagac

SEQ ID NO: 335262 - DNA, 359 bp, Homo sapiens
aaataccacagagaacttctgagaggctgtgcccccagatcccaatgttggttttctctggggaatagatgacgggctattttctgtttcctctttagactagtctgtctttttcaacgtttctacaaagagcagaaatccataaacaacccaccagaacgtgtcaatccatgtaactttccaagacccataggggatccccaagtccaagtgcatcctcatgggaatggcttgggaaatgccagacactttccagcctgggtctcacagtggacctgtctgcctctgcaggaccagaaaatctacatctacaccctcaagggcatgtgcccgttaaacacaccccaacaggccttgga

SEQ ID NO: 335263 - DNA, 334 bp, Homo sapiens
ggcagcagcacagcctgggagttcagtcaggtgctgggtctcgacatctccacccgctggctcggtagcggggtcctctcctaaccagccccgagaaagatgagcatagctgctgcttggttttgaaggaacacattcctgtgtctatatttgtctggagcccactagtggattttgggaggattccgtttcccaaacacacagtttgggctgcaggaactgcagtgattatggcaaattggcaggtgcggggattgtttatgaattgctgtttttggtcccagcttgagcttttaattcacagagcaaactgttgggtgcagtggaaacagca

SEQ ID NO: 335264 - DNA, 922 bp, Homo sapiens
agcggagggacacgagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgcacccgatgctgttcagttaccagcgctccctgccacgccagcccgtgccctctgtgcaggacaccgtgcgcaagtacctggagtcggtcggccatcctctcgaagaggaattcgatgacgggctgcgcggatcatgagtgggcttagtgagaggtagtggcaagcaggaggcaataggaggggagaggacgagacacaataaagaggaga

SEQ ID NO: 335265 - DNA, 477 bp, Homo sapiens
tccatggaaggagtttggactctggggccagacacacctaggaacccgcctggctctccctggctgtgtgaacctggccaaatgatttcccctctctaagcctcagttccccatctgtaaaatggggttgatattcccaccttgcagggatgtggcaaactcagttgaggccagatgtgccgcaggcccagccctaagtcgacttcctgtctttccatgacctgtgacctccctggggactgcaggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggttggggcacagggaaagggttagagagggaagtgggagaccatggaagaagggagaggtttcagggaaggagggtgat

SEQ ID NO: 335266 - DNA, 2805 bp, Homo sapiens
agcggagggacacgagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgaggtcccgaattgacgtccttccctcaaaacctccgggtctacaaaccaggaccctcaagacccttcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgcacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctggg

SEQ ID NO: 335267 - DNA, 3430 bp, Homo sapiens
agcggagggacacgagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgaggtcccgaattgacgtccttccctcaaaacctccgggtctacaaaccaggaccctcaagacccttcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgcacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctgggaaaaaaaaaaaaaaaaaaaaaaaaaaaaaaaaaaaaaaaaaaaaaaaaaaataaaaaaaaaaataaaaaaaaaaaaaatttgatgggagaaatcttttccgtgcggtttgaattagagctaatttggccttttgcccctatagggagcggactgaaaataaagtgcctttggctaaacaccctaaaaattgggaaaacccctgttaaacccacgttatttgaaaaccacaaaattggcaaatcctaagggggccaaaaaaaaaaaaggttggaacaaatgcccttttcaaaaagtggcgcaacctgaaaggggattgaaaattttgcccttcaaaatattgtaaaaataagagtgaaattttaaatttgcaggctaattttttaacaataggccgaataaacttattttttatcaaatcaatttataaccccaagcccggtttgggtaaaagcctattttggacaaaagattcgccttttaatgaactttggcttcaaacgaaaattggcaaagaaccggtttttaaaagaaagggggccttaaatgacaaattccggtaaacgggtttttatgggaaagggcccttaaaaaactttttccgtaaccaaatttttggccgccctt

SEQ ID NO: 335268 - DNA, 2754 bp, Homo sapiens
gctgagcggatgaatttatagacaccatccccctcgccttggcatgaaaagcggcaatggggtggacagcgtcaatgtctaacaggtgttgtttcatatgggtctaaaactaatgcttttctcaagaccccgcaactcagcctggaccagtttccctcctccacccacccccgaatcttgagaatcctgtactggggggagggcactgcccccgcaccatgttcttgggagagcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgcacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctggg

SEQ ID NO: 335269 - DNA, 2104 bp, Homo sapiens
agcggagggacacgagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgaggtcccgaattgacgtccttccctcaaaacctccgggtctacaaaccaggaccctcaagacccttcagggctccagcgtgacatggctgaagcgcaccaggccgtgggcttccgaccctcgctgacctcggacggggctgaagtggaactcagtgcccctgtgctgcaggagatctacctctctggcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctggg

SEQ ID NO: 335270 - DNA, 1200 bp, Homo sapiens
agcggagggacacgagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgaggtcccgaattgacgtccttccctcaaaacctccgggtctacaaaccaggaccctcaagacccttcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgcacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggcagctcgcgctgggaatgccgtccatgccctcctcctgtaccgccaccgcctgaaccgccaggagatacccccggtgagagggccccagtgggttagggatggaggtgtggtcctgtggcctttgggc

SEQ ID NO: 335271 - DNA, 2405 bp, Homo sapiens
gctgagcggatgaatttatagacaccatccccctcgccttggcatgaaaagcggcaatggggtggacagcgtcaatgtctaacagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggtgccatccagcttgcctggttcctccagctggatccttccttaggactgatggagaagatcaaagagttgctgcctgactggccctggtccgcatcttctctggccgcacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggacttcctgtatgtcacacccacgcctctgcaggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctggg

SEQ ID NO: 335272 - DNA, 917 bp, Homo sapiens
tccatggaaggagtttggactctggggccagacacacctaggaacccgcctggctctccctggctgtgtgaacctggccaaatgatttcccctctctaagcctcagttccccatctgtaaaatggggttgatattcccaccttgcagggatgtggcaaactcagttgaggccagatgtgccgcaggcccagccctaagtcgacttcctgtctttccatgacctgtgacctccctggggactgcaggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctggg

SEQ ID NO: 335273 - DNA, 617 bp, Homo sapiens
gctgagcggatgaatttatagacaccatccccctcgccttggcatgaaaagcggcaatggggtggacagcgtcaatgtctaacaggtgttgtttcatatgggtctaaaactaatgcttttctcaagaccccgcaactcagcctggaccagtttccctcctccacccacccccgaatcttgagaatcctgtactggggggagggcactgcccccgcaccatgttcttgggagagcagggctccagcgtgacatggctgaagcgcaccaggccgtgggcttccgaccctcgctgacctcggacggggctgaagtggaactcagtgcccctgtgctgcaggagatctacctctctggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctggg

SEQ ID NO: 335274 - DNA, 627 bp, Homo sapiens
ctggatccttccttaggactgatggagaagatcaaagagttgctgcctgactggtgaggtccccccactccagcccagtaacccccaatcactctcccttcacccagtaagttcctctgtcattgtggtgtacctgctaaagaaaagtaacctctgagacttacattgggtcagattaataaaggcatggcatgaagaaaaaggaggtgaggccgggcacagtggctcacccctgtaatcccagcacattgggcattgggaggctgaggtgggtgtatcgcttgaggtcaggagttcgagaccagcctggccaacatggtgaaaccttgtctctactaaaaatacaaaaattaggccaggcatggtggctcatgcctgtaatcccagcactttggaaggctgaggcacgtggatcaactgagatcaggagttcaagaccagcctggccaacagggtgaaaccctgtctctactaaaaatacaaaaaattagctgggcgtggtggcaggagcctgtaattccagctactagggaggctgaggcaggagaatcgcttgaacccgggaggtggaggttgcagtgagccgagattgcgccattgcactccagcttgggtgacaagagcgaa

SEQ ID NO: 335275 - DNA, 397 bp, Homo sapiens
ggtccgagggagaagaggagagggacgtgggtgtgggtggtgagacgagtgaggggcgtggccagatagggcgtggtcaggagaagggcgtggttagggagaaggaggcccggatttacgggtaaaaaaaaagccagggatgcagggagtgaagtggagccaagggccggaactgcagatctctgtcctgcacatgtgatgggctcctgtcctcaggtccattcggagcagtggcagctgtccaccagccagatccctgttcagcaaatgcatctgtttgacgtccacaattacccggactatgtttcctcaggcggtggattcgggcctgtgagtggagctgggcgcgctggcccccagaggaaagagggggctggggggcctgcactcctgcata

SEQ ID NO: 335276 - DNA, 888 bp, Homo sapiens
ggtggtgagacgagtgaggggcgtggccagatagggcgtggtcaggagaagggcgtggttagggagaaggaggcccggatttacgggtaaaaaaaaagccagggatgcagggagtgaagtggagccaagggccggaactgcagatctctgtcctgcacatgtgatgggctcctgtcctcaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctgggaaaccaacaccccctttcaacaccatctaccccccacaacaacaaacaccacctcacaacaccctaacaaccatactcacacacaccaccgccaccaacaacacacaaaacacgcggccccccacaaatacaacactcacaacatacaacacaaaaacagaaacaaatcattcaaaaaaacccaccca

SEQ ID NO: 335277 - DNA, 2993 bp, Homo sapiens
agcggagggacacgagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgaggtcccgaattgacgtccttccctcaaaacctccgggtctacaaaccaggaccctcaagacccttcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgcacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctgggaaaccaacaccccctttcaacaccatctaccccccacaacaacaaacaccacctcacaacaccctaacaaccatactcacacacaccaccgccaccaacaacacacaaaacacgcggccccccacaaatacaacactcacaacatacaacacaaaaacagaaacaaatcattcaaaaaaacccaccca

SEQ ID NO: 335278 - DNA, 2861 bp, Homo sapiens
agcggagggacacgagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgaggtcccgaattgacgtccttccctcaaaacctccgggtctacaaaccaggaccctcaagacccttcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgcacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctggggaaataaataaatgttccgtaaacttaagaaattaataaaactcaaggggggggcc

SEQ ID NO: 335279 - DNA, 2736 bp, Homo sapiens
agcggagggacacgagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgcacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctggg

SEQ ID NO: 335280 - DNA, 2857 bp, Homo sapiens
agcggagggacacgagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggggtcttacttactttgttacccaggctggagtgcagtgtcaccatcacagctcacttcatccctgaactcctgggctcaagcgatcctcctgcttcagccttccaagtagctgggactaagaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgcacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctggg

SEQ ID NO: 335281 - DNA, 2450 bp, Homo sapiens
agcggagggacacgagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgaggtcccgaattgacgtccttccctcaaaacctccgggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgcacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctggg

SEQ ID NO: 335282 - DNA, 5950 bp, Homo sapiens
gcggccgcgctcgaggggcgcgcggctgcagcggcggcggcgccgcgcgtgaggggccgcctaaggccgagcgggcgcggcgagcggccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgaggaaaacagaagagatcgcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggagagcatgcctccacctcaggcacataaccctggctgcattgtaccctcaggaagcaatggcagcagcatgccagtagaacacaatagcaaacgtgagaagaagattgactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatgagtatgtctaactgtatgtcaaccccagaggcccttcaccgcaacaacttggtaggaaagattcatccagttgtttgtgacagcaaagatgagcccacagagaagcaggctcacttcctgcacagctgtctctgtcggagagcaagtctgttttgggaactagaacgcaattgtgaaattataagaccagtggatttttttacctggcacatgggttggtgttgaatgaagtgttcagatggataaggatcaatctcatattcattccctgggatgtttagttaccagttttcccaaagtgttctggtagcatctaccatatttcatcaaatctgtgattcctttgattattatatgaaccattattttatgtatcattaagaaaaaatactgccaattaaactctgtcatatcaaaaaaaaaaaga

SEQ ID NO: 335283 - DNA, 5806 bp, Homo sapiens
gcggccgcgctcgaggggcgcgcggctgcagcggcggcggcgccgcgcgtgaggggccgcctaaggccgagcgggcgcggcgagcggccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgaggaaaacagaagagatcgcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatgagtatgtctaactgtatgtcaaccccagaggcccttcaccgcaacaacttggtaggaaagattcatccagttgtttgtgacagcaaagatgagcccacagagaagcaggctcacttcctgcacagctgtctctgtcggagagcaagtctgttttgggaactagaacgcaattgtgaaattataagaccagtggatttttttacctggcacatgggttggtgttgaatgaagtgttcagatggataaggatcaatctcatattcattccctgggatgtttagttaccagttttcccaaagtgttctggtagcatctaccatatttcatcaaatctgtgattcctttgattattatatgaaccattattttatgtatcattaagaaaaaatactgccaattaaactctgtcatatcaaaaaaaaaaaga

SEQ ID NO: 335284 - DNA, 5855 bp, Homo sapiens
gcggccgcgctcgaggggcgcgcggctgcagcggcggcggcgccgcgcgtgaggggccgcctaaggccgagcgggcgcggcgagcggccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgaggaaaacagaagagatcgcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgacggaggcacaacctcacggtgagagcagcaagcacccctcctcaggccacagcttggcgtctttgttcgcctggtcaccttgggcaagcaccagccccatctctaaaacatgctgccgcctggctggacctcagaccagaagctggagaatccacaccgtgcacttcctgggccacctcctttcccctccccagtgggagaagcggcactttgtcacttgggtgaatcaacagcctctgctttttccagaaagcaagagaactgaaaatcctggattaactaagtgacagtatttttttttgcacttactacacacctccactgtatagaaacctctacagattccaacagactttattcttgtacaattttaatcagttcttactgtagaatctggagtcaatgctctaatctgttttttataaataatatatattatgtatatgaaatgtgtatctatagtatgtctggagacagacaaggctgcacactaaaatgcagataaaggtgatttgtagaaaatc

SEQ ID NO: 335285 - DNA, 2817 bp, Homo sapiens
  misc_feature (2544)..(2544): n is a, c, g, or t
  misc_feature (2696)..(2696): n is a, c, g, or t
gcggccgcgctcgaggggcgcgcggctgcagcggcggcggcgccgcgcgtgaggggccgcctaaggccgagcgggcgcggcgagcggccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgaggaaaacagaagagatcgcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagttatcacctgggaaaaaccagccatacagagataggagctgaagggacacagtgagaagtgaccagaagacaagtgtaagccctctgttactcccaaacagggccactagagggctccctggtctagtggtaaggccagtgcctgagaaggcgcccattacctagcgggccttggtctagcagtagcgtcagtgcctggggaaggcactagttacttagcagactgggaaagggagtctcccttttcccgggggagttagagaagactctgctccaccacctcttgtggaaggcctgacatgagtcaggcccgcccgcagccatccagaggcctgtctccctgtgatgctgtgcttcagtggtcactctcctggtctgctttcatgttccaccctgtacgcctggctctgccttctcgatagcagtaacaggattagngaaagtacttaaagtctttgaaatacatagaagaaataatggtgtaagctgtcctctctctgtctccgccttggctgccaaacagggaagggacccttgtccagtggacacatgacttgcgtgaccttcctgtcattggtgatggctcacantctttcccctgcccccttttcttgtatccaataaataacagtgcagccaggcattcggggccactaccggtctctgcgtctaggtggtagtggtcccccgggcccagctgtcttttcttct

SEQ ID NO: 335286 - DNA, 3742 bp, Homo sapiens
agacgatcttatgctgctccctcttcagatccctgctggtaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggagagcatgcctccacctcaggcacataaccctggctgcattgtaccctcaggaagcaatggcagcagcatgccagtagaacacaatagcaaacgtgagaagaagattgactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatgagtatgtctaactgtatgtcaaccccagaggcccttcaccgcaacaacttggtaggaaagattcatccagttgtttgtgacagcaaagatgagcccacagagaagcaggctcacttcctgcacagctgtctctgtcggagagcaagtctgttttgggaactagaacgcaattgtgaaattataagaccagtggatttttttacctggcacatgggttggtgttgaatgaagtgttcagatggataaggatcaatctcatattcattccctgggatgtttagttaccagttttcccaaagtgttctggtagcatctaccatatttcatcaaatctgtgattcctttgattattatatgaaccattattttatgtatcattaagaaaaaatactgccaattaaactctgtcatatcaaaaaaaaaaaga

SEQ ID NO: 335287 - DNA, 1577 bp, Homo sapiens
gcggccgcgctcgaggggcgcgcggctgcagcggcggcggcgccgcgcgtgaggggccgcctaaggccgagcgggcgcggcgagcggccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgaggaaaacagaagagatcgcacaggaaagacaacgacaacttgaaagcatggggatttccctggagatgtccggtatcaaggtgggggatgacaaatgctacttagtcaatctgaatgcagaccctgctcttaacgaacttctggtttattatttaaagtctttcaaccagtctcgacgtttcctcttaggtgagtttatgctaaaagagtgattatttccccatagga

SEQ ID NO: 335288 - DNA, 1291 bp, Homo sapiens
gcggccgcgctcgaggggcgcgcggctgcagcggcggcggcgccgcgcgtgaggggccgcctaaggccgagcgggcgcggcgagcggccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaagctggtcacagtggctcacatctctaattccagcactttgggaggccaaggcaagaggatcacttgagccgaggatttcaagaccagcctttgcaacatggcaaaaccccatctctacaaaaaatttgtttaaaattagctggacgtggtggcgcatacctgtggtcccagctactcaggagactgaggcaggaggctccagtgagctgtttgagccactgcacgccagcctgggtgacagagccagaccctgtcttcaaaaaaataaaaaattaaagtggcgtgaggtgaattgcatcagaccccacatatgaataaatggatggttggcaaagtgttatatataataagtacaattccttaggtgtccttaggtgtactactaaagtgggtttgtgatagcccatatatttagtcatttatgttcaatagtgttatattcatttgagaaattattttaagaaatttaaaattaagaaagttttaaaagtcctttagtaattagagatttctctgggtgggtggatacggttgtttctaattatcccacacatttaatcatttatgttcaatagtgttgtattttttgagaaattattttaagaaatgcaaaattaagaaagatttaaaagtcctttagtaattagagatttttctagttgggtggataagggttatttctaagtatcttttgagtattttttgtcatatatttcgttttttaggcatgattaaaagtgtatttgaggactcttagacacataaagttgaattcctcagattgagagatagttattgctttttaattttgttaagatgctcagctgttggataaataatgcttttgttaaaatcctgtggggcattcatccaacaaatggggtataagaaaggaatgtgtgtttgtgtacatgttcttctatctgttggtcctaaagagtgtaagaaggtaaatttgaccagtgaaattcataattacagagttttatttggtaatccattaataaatcattttctgaaagcacatgtctgtga

SEQ ID NO: 335289 - DNA, 337 bp, Homo sapiens
gtaagaagttgcttttatagaccagatgtgggggatcatgcctataatcccaggacttggtgaggctggggtgggaggatctcctgagcccaggagtttgagaccagcctgggcaacatagtaagacccgtctttataaaaactaaaaacattagcccagcgtggtggcacacctgtagtcccagcttcttgggagactgaggtgggaggatggcttgagcccaggagtttgagactgtagtgagccatgatcacaccactgcactccagcctgagcaacagggtttgaggctaagttggccactcttctgctatgttaccatggccagtatatggg

SEQ ID NO: 335290 - DNA, 384 bp, Homo sapiens
atttgcacagatggaagttatcatgaaaaccctgaatagtaatggtaagaccctcactctgtgttccagcgccttgggcatttcctcacctcacaccattcagtgagggataagcatgcatcaggtgtcattccgcattccacattttaaacacataaaactgctcatttctttaaaaggccatcagtgaataactaatgacaagatgtgggggagatggtcttctccctcagttacaatgaggatatggatggtcccgtttttgagacctcttattcccaagcgaattgtggtgacatttccacgggcctagagtactgaatgattttgacaaaattccttaccaaatttctcatcatcgagcctgtcatatctgaatccttg

SEQ ID NO: 335291 - DNA, 192 bp, Homo sapiens
cctcccaaggtatttgcctttgattattgcttttggtccatggatgaatctaacactacaaaatacgctggtaagttttctccctctacacctgacagttgggcttctggcctcttcttccattgagtttattttctttaattcctctggagttttactttccctgtgtaattcacacctgttctttccaat

SEQ ID NO: 335292 - DNA, 562 bp, Homo sapiens
tggtgacaaaggcatcagaggaatcataattaatacatatacctggtgtgcaggactacattcttgtgtttttgcttatggtcttttccttatgctttgcccctaggatattgagtcattgatgtctgagggaaataagtctcgaacggtagctgctaccaacatgaacgaagaaagcagccgctcccatgctgtgttcaacatcataatcacacagacactttatgacctgcagtctggggtaagggattaggcagaacctttttggagtgggggtggaagaactgaaagtgtccatataggtaaagtctttcatggttgggttcagtggctgagaattgtatgttggctcttctgcttactaggtgagctactttgcttatcatttaatttgttaggtctttctttatatttgactttttaaaaaattggattttggcctggtgcagtggctcctgcctgtaattccagcattttgggagtctgaggcgggaggattgcttgagggcagaagttcatgaccatcttgtacaatatagcaacacccagactctacaaaaac

SEQ ID NO: 335293 - DNA, 147 bp, Homo sapiens
gtgttttatcagctaacaagatgtaaaatacatattttgttatgattaaatgttgttattaaatttaggatcccacctcctggaatggaaacccacataccagttctcttcctcgatttgaatggtaagtagacacttaaagtcaca

SEQ ID NO: 335294 - DNA, 571 bp, Homo sapiens
gtgaacctgagaggtggagcttgtagtgagcggagatcgcaccactgcactccagcctgggcgacagagcaagactctgtctcaagaaaaaaaaaaagaaagaaacgggttgagttaaattacctcccaattttctttccagatctaacattctgtggttctttatggttttctataaaacagaagagacggatttaaggtcacgatcaggctaatatactctaaaataaatataacagttgaaaggtcaaaaggaaatttcacagactcctttaagcataattcttttgctttcccccacttatcccaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtttgtacttggctgtgagctttaggtacaaggttaagactaggacttgagcagagtctctgaacctactctggcctaggaggctgcttataaaaaaataaaatcattt

SEQ ID NO: 335295 - DNA, 5845 bp, Homo sapiens
gcggccgcgctcgaggggcgcgcggctgcagcggcggcggcgccgcgcgtgaggggccgcctaaggccgagcgggcgcggcgagcggccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgaggaaaacagaagagatcgcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatgagtatgtctaactgtatgtcaaccccagaggcccttcaccgcaacaacttggtaggaaagattcatccagttgtttgtgacagcaaagatgagcccacagagaagcaggctcacttcctgcacagctgtctctgtcggagagcaagtctgttttgggaactagaacgcaattgtgaaattataagaccagtggatttttttacctggcacatgggttggtgttgaatgaagtgttcagatggataaggatcaatctcatattcattccctgggatgtttagttaccagttttcccaaagtgttctggtagcatctaccatatttcatcaaatctgtgattcctttgattattatatgaaccattattttatgtatcattaagaaaaaatactgccaattaaactctgtcatatcaaaaaaaaaaaga

SEQ ID NO: 335296 - DNA, 6105 bp, Homo sapiens
gcggccgcgctcgaggggcgcgcggctgcagcggcggcggcgccgcgcgtgaggggccgcctaaggccgagcgggcgcggcgagcggccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgaggaaaacagaagagatcgcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggtaaatgcttgacttgtctgtactatgcagaatagagcagagttgtgtcacctgtgaagcagcagtgtgcattagcaagctgagtgctgcatgtggacatgcacggtcatcactccatggttcccgttctcgaattcctctttctcaagcatgcagagtcatggtagaatctcttgtttgttgttgctgctgtggttttatttctttgtgtttatggcttttcaaagtatttttttatgtttcaagtgagaaagatgttttctaggtgttttgaaaagattaaaggccttttttaaaattatttttcttttttgtctttttggggatttctgattttgttttttatagagatagggtcttgctgtgttgcccaggctggtctgaaactcctggcctcaagtgattcttttgccccagcctcccaaggcactgggattgcaggcatgagccgttgtacctggtcaaaaggctgttttttaaataagactaattatgctttttgccacagaatctgtttattcctgtcatatctctccagtagtttaactctggcctgcagaattggctgctgcattactcacatgtaataaaagtgttagcattgcttttctaacttgcatgtacttaatatgtattttggccgttgtcgtctttgtgtgtgatgcatctgtgtgtcttaacctttgcagagcatgcctccacctcaggcacataaccctggctgcattgtaccctcaggaagcaatggcagcagcatgccagtagaacacaatagcaaacgtgagaagaagattgtaagttccggaaccatttctgtcatattgcctggtggtgggtttaaggccctttcacagacaatcatccaaatgctagaagaaattaagacatgtattgggtctttgtcttaaagaaaataaaaatgtgaccattggtaatgatattttgcatggatgtggccatgacctacaattttatcttatttatttatttattttttgcttaagtttgcttagaaaaagggagaaaggcacttttattgcttctggcctttataaaaagtgtaacaaagagatctttttaataccaaaatctttctaatgtgcctatacatattgcctagattctgaagttaatctacctagaggaagtgcacttacttggagtaagtaatcatgcatttaatgcatttagctgtggatatgtttggaagcttttttatgttgcctgatgctattgccaagataattctgtagttagagctgcactacaatctatcataatcacccttcatcgtctcactgtctagggtagcctttgttaattagctggcaaaatatattccaataccttggtgccagccttgcattcaggatggcttatatatattttgccacaggtaggctgaaactctacccacaaaacctcattccttagcacttggttttaaaattattaatttgagatacagttttaaaaacactgcataccaggcaccttaggttataaattatacctcaatttac

SEQ ID NO: 335297 - DNA, 5662 bp, Homo sapiens
gcggccgcgctcgaggggcgcgcggctgcagcggcggcggcgccgcgcgtgaggggccgcctaaggccgagcgggcgcggcgagcggccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgaggaaaacagaagagatcgcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccaggtaataattccagaggcagccttttgggttctgtgctgtcaatgagtatgtctaactgtatgtcaaccccagaggcccttcaccgcaacaacttggtaggaaagattcatccagttgtttgtgacagcaaagatgagcccacagagaagcaggctcacttcctgcacagctgtctctgtcggagagcaagtctgttttgggaactagaacgcaattgtgaaattataagaccagtggatttttttacctggcacatgggttggtgttgaatgaagtgttcagatggataaggatcaatctcatattcattccctgggatgtttagttaccagttttcccaaagtgttctggtagcatctaccatatttcatcaaatctgtgattcctttgattattatatgaaccattattttatgtatcattaagaaaaaatactgccaattaaactctgtcatatcaaaaaaaaaaaga

SEQ ID NO: 335298 - DNA, 2571 bp, Homo sapiens
caggaagattcattgagcctaggagttcaagaccagactggacaacatagtaagacctcatctctattaaacataatgattttttaaaaaagaaaaaaagctgttgtgagtcttggagtctctatttcaactgcagaataaggaatgaaagaaaaaagaaaaatgtgttatgtgtaaacttcaactgtaaaaagcatatatttaaatttttggtgtttgcttaaaaactgactttcccctactgttttttctgtgctcctgatgtggttagcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggagagcatgcctccacctcaggcacataaccctggctgcattgtaccctcaggaagcaatggcagcagcatgccagtagaacacaatagcaaacgtgagaagaagattgactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatgagtatgtctaactgtatgtcaaccccagaggcccttcaccgcaacaacttggtaggaaagattcatccagttgtttgtgacagcaaagatgagcccacagagaagcaggctcacttcctgcacagctgtctctgtcggagagcaagtctgttttgggaactagaacgcaattgtgaaattataagaccagtggatttttttacctggcacatgggttggtgttgaatgaagtgttcagatggataaggatcaatctcatattcattccctgggatgtttagttaccagttttcccaaagtgttctggtagcatctaccatatttcatcaaatctgtgattcctttgattattatatgaaccattattttatgtatcattaagaaaaaatactgccaattaaactctgtcatatcaaaaaaaaaaaga

SEQ ID NO: 335299 - DNA, 1237 bp, Homo sapiens
gcggccgcgctcgaggggcgcgcggctgcagcggcggcggcgccgcgcgtgaggggccgcctaaggccgagcgggcgcggcgagcggccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaagctggtcacagtggctcacatctctaattccagcactttgggaggccaaggcaagaggatcacttgagccgaggatttcaagaccagcctttgcaacatggcaaaaccccatctctacaaaaaatttgtttaaaattagctggacgtggtggcgcatacctgtggtcccagctactcaggagactgaggcaggaggctccagtgagctgtttgagccactgcacgccagcctgggtgacagagccagaccctgtatatgaataaatggatggttggcaaagtgttatatataataagtacaattccttaggtgtccttaggtgtactactaaagtgggtttgtgatagcccatatatttagtcatttatgttcaatagtgttatattcatttgagaaattattttaagaaatttaaaattaagaaagttttaaaagtcctttagtaattagagatttctctgggtgggtggatacggttgtttctaattatcccacacatttaatcatttatgttcaatagtgttgtattttttgagaaattattttaagaaatgcaaaattaagaaagatttaaaagtcctttagtaattagagatttttctagttgggtggataagggttatttctaagtatcttttgagtattttttgtcatatatttcgttttttaggcatgattaaaagtgtatttgaggactcttagacacataaagttgaattcctcagattgagagatagttattgctttttaattttgttaagatgctcagctgttggataaataatgcttttgttaaaatcctgtggggcattcatccaacaaatggggtataagaaaggaatgtgtgtttgtgtacatgttcttctatctgttggtcctaaagagtgtaagaaggtaaatttgaccagtgaaattcataattacagagttttatttggtaatccattaataaatcattttctgaaagcacatgtctgtga

SEQ ID NO: 335300 - DNA, 189 bp, Homo sapiens
ctggaaacataaaagtcattttttttcttcgaatttgtagtcccaaaaccactgctcataaaaataagctttacaacatctttgagaatccaaaagaaccccggtcaagatttttttggctagaaaagaaagcagttttgatattcaaaaatttggctgctcttagtcaatccccaaaagagaaaaatc

SEQ ID NO: 335301 - DNA, 200 bp, Homo sapiens
gtcgtagatcgagcggtaccccgcggccaatggcactttagaaggggaatattcatttttcatgagaacatcaataaaataagccacctcagcaccaacaacacggagattgtttacagcatggatgtattcccgtgaaccgttgatccaatctaaattaatgcaatttatatcttccagctgtagcaacacctggcaca

SEQ ID NO: 335302 - DNA, 1548 bp, Homo sapiens
gtggattaacaactgtctttattccaatggagttttttgggggttttttcttcttcttaaagacaaaaaaataatctaccgctgacactcaacaagaaccgtcgtagaatggacaagtcttcggatcgcgctgtgcagatccctcagcaaattgtgacagtattatggcactttggcctaagctgttaaagagacgatgtaatgaacagctgcggatttctgaggcacaattgtgtgacacaggaagcccaagtgttggccatcctcaacgaaggcagctgccgggctccggtttgcttcagcaaaccctcacccctcgccttcaaccaggcgggtgtcgtcagctgtccgccagctgctgcccgcgcctttccgcccccgcgcgccggccaaggccgaggcggccgggaccagaggcgcgcgccctcagtgcatgtgacggggtgggagggggaggtttcttcctcccccgtccccaagccccgccttctccagagaggctgcggcttcctattgcgccaccaccgaaatgaccaccgtgccagccaatcaagacgtgattcatgaagtaagacccgccccttactggtccccaggttccttcccgctcacgccggagtcacttccgaagagagaaccgccatgaagagagaagggggtgccgcccacctctgctccgacagcctcccggagtcccagcagcaagacggcaaccacgcacccaacttctccagccacggctcatgccgccgtcgccagcggcgccgacatgacaaggcgctgcatgcccgctaggccaggtttcccctcatccccagccccggggtcgtcgcccccgcgctgccatctgagacccggtagtaccgcccatgctgcagcgggaaagagaacagagagtcctggggacaggtaccgtgcagagggcttgagaaggggccgggtcgcgggggcaagggtatgaggggagggctgcagaccgccgctcttccagttcccgccatcctccgcgagctcaggcgttggcatttcggggcctggcaaatccccgccccgcctccgcgcaggggctactgggagttggagtttgcttctctgtagttgggcagctgctcttggtctagtgaccaccagcctggacagctacggagaacccgccttaggtagaaagaaagtgatttttttcctttgcaagagtttgacccgggaccctaactgcttaatgcatatttagatcgttttctgtacgttgtcagttctactgatcctagtggtttagtaatataaaccttttctatgttgtgggtgaaattatgtaacctgtgatgagggaatcccttccacgaattactttgtagtccagcgtgcacgctagttcatacttaaaagaacttgcagatttggaatgtgacgtgttttctctttcagtaacttcacgcctctccaagaggctaatttttttgtaaagattttgtgggagctatgtaatgagatggggagtttcatctaatgacatcctctgacaataaaacatgtttaaattccctacga

SEQ ID NO: 335303 - DNA, 364 bp, Homo sapiens
ttaccattgtcagaactttattaaaccaaatagtgaaatccagcctttattttataaatctttctccatttaatctgagttatgaaggttttaatatttgcttatatgatgccatattatgcttttattttcaggaagcagtcaattatagatttcttcaaaccagcttcaaaacaaggtatgtacactgttgatgcattttttgtgggctattttgggggtgaggagagagacagattcaactttaaaacctactctaaactgttttagtaaacgtagtgttcaaaattgaaaataaaatgaagatgcagtattttgttttacaaggataaactgaagttctaaatatgaaagtctttttgct

SEQ ID NO: 335304 - DNA, 1460 bp, Homo sapiens
gtggattaacaactgtctttattccaatggagttttttgggggttttttcttcttcttaaagacaaaaaaataatctaccgctgacactcaacaagaaccgtcgtagaatggacaagtcttcggatcgcgctgtgcagatccctcagcaaattgtgacagtattatggcactttggcctaagctgttaaagagacgatgtaatgaacagctgcggatttctgaggcacaattgtgtgacacaggaagcccaagtgttggccatcctcaacgaaggcagctgccgggctccggtttgcttcagcaaaccctcacccctcgccttcaaccaggcgggtgtcgtcagctgtccgccagctgctgcccgcgcctttccgcccccgcgcgccggccaaggccgaggcggccgggaccagaggcgcgcgccctcagtgcatgtgacggggtgggagggggaggtttcttcctcccccgtccccaagccccgccttctccagagaggctgcggcttcctattgcgccaccaccgaaatgaccaccgtgccagccaatcaagacgtgattcatgaagtaagacccgccccttactggtccccaggttccttcccgctcacgccggagtcacttccgaagagagaaccgccatgaagagagaagggggtgccgcccacctctgctccgacagcctcccggagtcccagcagcaagacggcaaccacgcacccaacttctccagccacggctcatgccgccgtcgccagcggcgccgacatgacaaggcgctgcatgcccgctaggccaggtttcccctcatccccagccccggggtcgtcgcccccgcgctgccatctgagacccggtagtaccgcccatgctgcagcgggaaagagaacagagagtcctggggacaggaagcagtcaattatagatttcttcaaaccagcttcaaaacaagacagacacatgttggattcaccacaaaaatcaaacatcaaatatggaggaagtagattgtctatcactgggacagagcagtttgaaaggaaactatcctcaccaaaagaatctaaacccaaaagggtgccaccagaaaagagccctattatagaagctttcatgaaaggtgttaaagagcaccatgaagatcatggtatacatgagtcacgtcggccttgtctgtcactagcctccaaatatttagccaaaggaacaaatatctatgttccttcttcatatcacttgccaaaggagatgaagtcactaaagaaaaaacatcgatccccagagagaaggaagtcactattcattcatgaaaataatgagaagaatgatagagatcgaggcaaaaccaatgcagactccaaaaagcagaccacagtggcagaagctgacatcttcaataacagctccagaagccttagcagcaggagcagcctgtccaggcaccacccggaagaaagcc

SEQ ID NO: 335305 - DNA, 1747 bp, Homo sapiens
cgagtaggcgcgagctaagcaggaggcggaggcggaggcggagggcgaggggcggggagcgccgcctggagcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcagatgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggatcgtgggcggtgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggc

SEQ ID NO: 335306 - DNA, 724 bp, Homo sapiens
cgagtaggcgcgagctaagcaggaggcggaggcggaggcggagggcgaggggcggggagcgccgcctggagcgcggcaggtcatattgaacattccagatacctatcattactcgatgctgttgataacagcaagatggctttgaactcacctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgatttttttttcaaagta

SEQ ID NO: 335307 - DNA, 750 bp, Homo sapiens
ggttaagtccagcaggatgcctgggcttagtggcactggagttgtgggtggccttgagccccaggcagtcccctgagagcccttcccgatggatgtttgagtcactgagtgtgttccttcttctttctggtcaggctgtcctggccgctgcacttacaattgcaccccatcctcctacccactctgatcccagaggagagtgcttctgctgtaacctctaaggcacaagtgggtcccaaagtccttaaatatggagggatgtggggaagcagtggtgaagatgcaggccaaaggtcagcaggcaacactggtctttgttgtaggtaaccttcatctagagattcttctagttctttccagatttatcttctaaaaactaactggtatggaaatattacagtcctgtaattctttcttctaggtcatattgaacattccagatacctatcattactcgatgctgttgataacagcaagatggctttgaactcatcagtaagtggttaattattaccttcctggccttttctttgttcccttgtcccttctgttattcccaacattgtttggggtcagcaattgcaagggctatttgtagggaacgccgggccacgctgatgctgttcaaggcaccctctagaaagagtgagtcaggtgcgcagccacacagctgcccaggtgagtcgcaagagccatggctgttgggtacacgtgggtgatatgcattctcaccttgacctcatcccttcc

SEQ ID NO: 335308 - DNA, 708 bp, Homo sapiens
cgagtaggcgcgagctaagcaggaggcggaggcggaggcggagggcgaggggcggggagcgccgcctggagcgcggcaggtcatattgaacattccagatacctatcattactcgatgctgttgataacagcaagatggctttgaactcagaggtcaggagtttgagaccagcctgaccaatatggtgaaaccttatctccactaaaaatacaaaaattagccaagcacggtggcgggtgcctgtaattccagctattcaggaggctgaggcaggagaatcacttgaacctgggaggcggaggttgcagtgagctgagatcacgccactgcattccagcctgggagacagagctggctcaaaaaataaattaattaattaaaaacaaaattggagatgcactatgttattttcaaaacaagctgcctttaaaggtctatctgttgtcacagggtgggctcatctgtttcattttattttctgtggtttatctatttatttattttaatgaactaggaagcattgctcctatttatggcataccacatgatgtttggatacgtgtatgcctgtggcatggctaagtcaagctagaacatgggccttacctcatatacgtgtcttattaagaacacataaaacctactcttgtagtgattttcaaatatgcaacatatagtttattaactgcagtcactatgatgtacaa

SEQ ID NO: 335309 - DNA, 3465 bp, Homo sapiens
cgagtaggcgcgagctaagcaggaggcggaggcggaggcggagggcgaggggcggggagcgccgcctggagcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcagatgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggatcgtgggcggtgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgatttttttttcaaagtaaaaactgaacatctttgaagttctgcctggtgagtaggaccagcctccatttccttataagggggtgatgttgaggctgctggtcagaggaccaaaggtgaggcaaggccagacttggtgctcctgtggttggtgccctcagttcctgcagcctgtcctgttggagaggtccctcaaatgactccttcttattattctattagtctgtttccatgctcctaataaagacatacccaagactgcaatttacaaaagaaagaa

SEQ ID NO: 335310 - DNA, 3124 bp, Homo sapiens
catgagccactgcgcccagcgaagcataccatactttttaaaagagcctaacctcggtgtactttgctgaagatcacagcttcctcctgttggtctccaaattgcataaggtttagtgttatggaagaagtaggatcgtccatgatatttcttaaaattaaaagtcacatttttaagtgtatatgaaataattatttcttaatgtggtgtactataaaaataatagataacatttgagagcatgacttctaaacaactctggtctgaacgttgcactctcctccttcttccagagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcagatgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggatcgtgggcggtgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgatttttttttcaaagta

SEQ ID NO: 335311 - DNA, 2935 bp, Homo sapiens
cgagtaggcgcgagctaagcaggaggcggaggcggaggcggagggcgaggggcggggagcgccgcctggagcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccctgccccggcggggaggacgagaatcggtgtgttcgcctctacggaccaaacttcatccttcagatgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggatcgtgggcggtgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgatttttttttcaaagta

SEQ ID NO: 335312 - DNA, 1945 bp, Homo sapiens
gatgggggctatctctttgggggttacatctctgttaccatcaccccttgatggtggagattcgaagcccacacagtcactcgtaactcacactgcgacccccgccccccaactcctctaggcctggtcagtggtgtgcggcagattgtgacttgattttctgctctctgtaccttgctgtgtcccacagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgatttttttttcaaagta

SEQ ID NO: 335313 - DNA, 2481 bp, Homo sapiens
cgagtaggcgcgagctaagcaggaggcggaggcggaggcggagggcgaggggcggggagcgccgcctggagcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcagatgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggatcgtgggcggtgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgatttttttttcaaagta

SEQ ID NO: 335314 - DNA, 366 bp, Homo sapiens
cacctgaggtcaggagtttgagaccacaagcctggccaacatgttgaaactccatctctactaaaaatacaaaaattagtcaggcgtggtggcgtgcacctgtaatcccagctacttaggaggctggggcaggaggatcacttgaacccaggagttggaggttgcagtgagccaagattgtgcccctgcactccagcctgggtgacagaatgagacttcatctcaaaaacaaaacaaaacaaaacacagtggggccaggagttggaggctgcagcgagctacagtaatgccacggtgttcctcactccatgaggctcattgggtttctcagcctgaagggcacctctcttctgttttctctgcaag

SEQ ID NO: 335315 - DNA, 449 bp, Homo sapiens
aaggggagaccgagcccctcttccactatctccctgtgtggtttttggtgaaccatcctgcctctgggtgtcttgcctccagcttctgacgttggaagttcatcctccgagagctctgtgtttatggctctgagatactgagtccttcttctctcccagacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacggtacgtgtggctcaggcttggcaagcaggttggcagaatcttaaagagatgttgattggaaatgacacttgtgctatgccaaatggaagggaggcatttgcgttgagcgagggt

SEQ ID NO: 335316 - DNA, 360 bp, Homo sapiens
gggctatctctttgggggttacatctctgttaccatcaccccttgatggtggagattcgaagcccacacagtcactcgtaactcacactgcgacccccgccccccaactcctctaggcctggtcagtggtgtgcggcagattgtgacttgattttctgctctctgtaccttgctgtgtcccacagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggtaactatcctgtcctccttct

SEQ ID NO: 335317 - DNA, 3204 bp, Homo sapiens
cgagtaggcgcgagctaagcaggaggcggaggcggaggcggagggcgaggggcggggagcgccgcctggagcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcagatgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggatcgtgggcggtgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgatttttttttcaaagta

SEQ ID NO: 335318 - DNA, 969 bp, Homo sapiens
gcaaaagacctcatggaatccaagatgaagggaatatcgacaaatatttgtgcgcacctgcacctagtacaggctgggtgctactcaggtgctgggaatgcagaagtgaacagagtaagacaaatgtctctgctgtcaggagctttacctctcttctggatgtcggtggtggggacggggcaggtgtggtcagacagatgggagacaaacaactgagcgaggtacttccaaacatctgagggtggggatcacaaggtcccggctattttgaaggggtggtcaggaaaggcttctcggaagaggtggcatttgagctgagactcaaatggcaaaaatgtgtacacatcaaaaaggctagtgcatgtatcttcaggtgtggtcaaggggccaaggaggtgggctggggccagattgcataggtccttgtggattatggtgaagacaccagcttctcatctgcttgaggtggggagatcgtgagccggggagtgccatgatctggcagctgcgtggggagtggggatgaatggatggagacgaggatgatggtgacaagtccattgctgtggttccttgagacaggaagccagctcatagcagagtgcgggcgtggatgtgaagagatgagggtacactagggctagagccaccagacttactgatgggttgcatgtctgtgggagagagagtgagaagtcagggacgatggctttccactctgtggctgaagccccagggtggcgggtggtgccatttttcaagccaggaaatattggttggtgagaatttggggtgggagaaggtgtgacggagggttctggttttgcacactaagcccacggtgcccagaagatgcccgaggggaggcagcaaagcgagagtgggaaatgcagaggtggcaagtgcatggtcagagtccgataacactgcgatggtgttttcccgacggacgacaaaagaagttctgga

SEQ ID NO: 335319 - DNA, 3274 bp, Homo sapiens
gcaaaagacctcatggaatccaagatgaagggaatatcgacaaatatttgtgcgcacctgcacctagtacaggctgggtgctactcaggtgctgggaatgcagaagtgaacagagtaagacaaatgtctctgctgtcaggagctttacctctcttctggatgtcggtggtggggacggggcaggtgtggtcagacagatgggagacaaacaactgagcgaggtacttccaaacatctgagggtggggatcacaaggtcccggctattttgaaggggtggtcaggaaaggcttctcggaagaggtggcatttgagctgagactcaaatggcaaaaatgtgtacacatcaaaaaggctagtgcatgtatcttcaggtgtggtcaaggggccaaggaggtgggctggggccagattgcataggtccttgtggattatggtgaagacaccagcttctcatctgcttgaggtggggagatcgtgagccggggagtgccatgatctggcagctgcgtggggagtggggatgaatggatggagacgaggatgatggtgacaagtccattgctgtggttccttgagacaggaagccagctcatagcagagtgcgggcgtggatgtgaagagatgagggtacactagggctagagccaccagacttactgatgggttgcatgtctgtgggagagagagtgagaagtcagggacgatggctttccactctgtggctgaagccccagggtggcgggtggtgccatttttcaagccaggaaatattggttggtgagaatttggggtgggagaaggtgtgacggagggttctggttttgcacactaagcccacggtgcccagaagatgcccgaggggaggcagcaaagcgagagtgggaaatgcagaggtggcaagtgcaggccgtgtcttgagaagctctaatgtgcaggggagccgagaagcaggcggcctagggagggtcgcgtgtgctccagaagagtgtgtgcatgccagaggggaaacaggcgcctgtgtgtcctgggtggggttcagtgaggagtgggaaattggttcagcagaaccaagccgttgggtgaatagagggggattccatggcactgatagagccctatagtttcagagctgggaatttctttccctgaagctgaactccagagctgcattcagcacaggcaccgccagttgtaaggagaatccaggtttcccaggagaggggttggtgctgggatgagctgacgggggcagggctggagaatagggctgtgaccatctgtgtagtgcgtgtggaggtctcagggagggaagtgtgctctccctgcgagagctgcaggcaacactgggagctcaacaagtctccctgtccttagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgatttttttttcaaagta

SEQ ID NO: 335320 - DNA, 1907 bp, Homo sapiens
ggtccgggctggggaggggaacctgggcgcctgggacccgccgatgccccctgccccgcccggaggtgaaagcgggtgtgaggagcgcggcgcggcaggtcatattgaacattccagatacctatcattactcgatgctgttgataacagcaagatggctttgaactcagggtcaccaccagctattggaccttactatgaaaaccatggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgatttttttttcaaagta

SEQ ID NO: 335321 - DNA, 245 bp, Homo sapiens
ctgccccggcggggaggacgagaatcggtgtggtgagtcagccttaaccttgggaagggactcctctgctcaccttggagacagcagccgggtccaggggcctttgggtgactgggcctggcgtgcgtccagtacgctgacacatgatgtcattgaatccctgctccaggctgagccctggggctcagagaggttgtgtttccggcccaacctcacccagcaggtgggagatgacagggccaccg

SEQ ID NO: 335322 - DNA, 212 bp, Homo sapiens
ccttccctaacttgcttaattttgaacaggaaccttctttaacaaagtgagctatgaacccaaccaaagtctttttaaaacatcatgtgtttttccaaaaaatttaattgtagcaccaaagcagcatatcaaaatatcatttgcactgaattgatagatcatctatttggattcttagaattgggtgactagtgtatacaggacactgtagt

SEQ ID NO: 335323 - DNA, 219 bp, Homo sapiens
ctcggcctcccaaagtgctggaattacaggtgtgagccaccacgccgtgcttgaggcatatttttaaaataaaggtagcctgactggggcctagagcaaggttaatgactgttctcagccgtggagaaagtaagggagggagtgaacgttgcatcctggttgtttctgtgtcggtggcttttcttctaaagcactgcttattggtctttttctccagtg

SEQ ID NO: 335324 - DNA, 469 bp, Homo sapiens
ctgcctctccatccctctgctgctgcgctccatcagcctccctcacgcctcgcctggccaatggcaacagcctcttgctcatcagccttgcctcctgactctggtccttggctatccaactgtcccaatcgaccctctggaactcactattgtggacaatggtcatcattgaaggacacaccacccagggccttttaagaagtgactgcagactgtgtgtcccacctgccacttgactctgctcatcctctcgggtcccacagcaaggcccttcacactccccaagtgggcacactctctctgtgcatgcatgccaggcccgcctctgactcccctcctggggatcccgtctggctcagtgggaagcctatcgctcttggtaaattactcagtaagcacttctctcctgaggcctggctcctctcctgccctcggcgggagacctgggaacgggcctgccagcgcccag

SEQ ID NO: 335325 - DNA, 112 bp, Homo sapiens
aatgagtttttgaagacctctacatgagtggttttacttttagtatctgttgctgtgagaaacagaggttctacagattcagtaaggttgaatttcattgcatctatgaaca

SEQ ID NO: 335326 - DNA, 383 bp, Homo sapiens
gcagctgatgtatggatgggtagctggagagagaggccatcagtaacttcacatctctctgtttccatttcctgccctcaaatgccttcataatagagtctacgtaataaggttatagggattcagtgcagatgaagtgctggcacttgatacgggatcagtaagtattagctattattctatcacattaagttgcataaactttaacctcattactcttaaattctctatagaaacctagtctttatctgtcttacaagccctcaaatttagctaatagcgttgttcattgaataccttaaaattgtatttaaagacaggccgtgaatacaattaggcattgctttttgaagccaaaataccatgagggtggggagggtcat

SEQ ID NO: 335327 - DNA, 376 bp, Homo sapiens
cagcggaacaagcaacaacaacaacaaaaaaagacatctttctgtgtatttgcaaactacatatagtcttttcagtttttacaccaatagcagcattatgctaaagtattgtctctctcctcccccaccattggcttcagtaactgatttaatgtcatggaaaattttaaaaaacaatttatatatttttgatgagacggggtctcgctctgttccctaggctggtctggaattcctgggctcaagtgatcctctcacctgggcttcccaaaatgctgggactacaggcatgagccaccatgcctggccagtgtcatggaaattaaccttttgtgcatattgcaaatattattgtcccattcttttgcttgtgttt

SEQ ID NO: 335328 - DNA, 442 bp, Homo sapiens
ttttcgtgcctcagttacccaagtagctgggattacaggtgtgtgccaccatgcccggctaatttttgtatttttagtagagatggagtttcaccatgttggccaggctggtcttgaaatcctgacctcaggtgaaccacccccctccgcctcccaaagtgctgggattacaagtgtgagcactgtgcctgatcgccatccttttattggtgagaagaaaagggagcaagatgaggttgacccctgcatcttatgtgtgtactgtctctgcctctgtacacacacacatgcaccacagacacaccacacacacacagcccacatacacagcccacatacatgcacacacaatttagggttttcccccttctcacaaaaatcctctttaacgtgatttttactaataaagttataaatgtctggggttagaagacagccaaag

SEQ ID NO: 335329 - DNA, 417 bp, Homo sapiens
ttttcgtgcctcagttacccaagtagctgggattacaggtgtgtgccaccatgcccggctaatttttgtatttttagtagagatggagtttcaccatgttggccaggctggtcttgaaatcctgacctcaggtgaaccacccccctccgcctcccaaagtgctgggattacaagtgtgagcactgtgcctgatcgccatccttttattggtgagaagaaaagggagcaagatgaggttgacccctgcatcttatgtgtgtactgtctctgcctctgtacacacacacatgcaccacagacacaccaataagaggatggcgatcaggcacagtgctcacacttgtaatcccagcacttacatatgtcatggcactttctcctggcctataacgtttccactgaaagtctgctgcaatg

SEQ ID NO: 335330 - DNA, 583 bp, Homo sapiens
tcctacgaagatagaagggtttcgacgcaccgtgaagagagcttagtcactatgaagaggtccagtaggaaaaatgagacagacacacatcagccactggacctagagtgcaaggcagaatgtggcaaggacctgttagagaaccacactcaaaagaacccccacctcaaaaaaaaagtgggttgggggagaagcctatagcctttagggtgggccttgaaaagtcattaacagtttagaagaattttgctgcacagcactgtgtcaacagggacattcctattcttttacatttaggcaacagagtttgaataaatgcattgcactttaggctttacctcattttcccatattatccatctctccagaagatttcttccccacattttaacagcagccatttccacaaatcttggtctctttggtaatgactaaactagtagctttcaaactcagaactcttgttcagatagtgtggaagcataatatgtaaaatgaaggacagctgaagaaatttctggctgagatgggttcatcttcagaactcctctccttcccacttggccccaatgtcccttctctc

SEQ ID NO: 335331 - DNA, 112 bp, Homo sapiens
taaaattcttaaatgtcttttacaactttgttgactaaagtagtaatatgaaaaaaacgcccaggcacagaggcctgtaatcccaacactttgggaggccaaggtgggtcaa

SEQ ID NO: 335332 - DNA, 336 bp, Homo sapiens
tcctcagctactcgggtggctgaggcatgggaattgcttgaacctgggaggtggaggttgcagtgagccaagatcacaacactgcactccagcctaggcgacagagcgagaccccgtctcaaaacaaaaaagcaaaaaacaaaacaaaacaaaaaaacaaacaaaaaaccccacaccactactttgcagctgatccaagtatagttaacaaagggttccacttgatcagctgaggaccatcgttgaccgatggtcctcagctacgagtgctgtcctggatatgacaaggtccctgggggagaagggctggccagcagaccatacactctcaaacct

SEQ ID NO: 335333 - DNA, 272 bp, Homo sapiens
tcctcagctactcgggtggctgaggcatgggaattgcttgaacctgggaggtggaggttgcagtgagccaagatcacaacactgcactccagcctaggcgacagagcgagaccccgtctcaaaacaaaaaagcaaaaaacaaaacaaaacaaaaaaacaaacaaaaaaccccacaccactactttgcagctgatccaagtatagttaacaaagggttccacttctggatcagctgaggccatcgttggggatctctagagtcacccgcatca

SEQ ID NO: 335334 - DNA, 1416 bp, Homo sapiens
agcagacaggcacaggcagcctgcatacactccttttcctggtgtcaacattatttaaaagcatgggaaatagtaatgagacagtgtcttcttcattagaaccttaggagtctactagatttcttcatctctatttgttgttattagtagccaaactgtgcaaaaaacacggtcttgagaaatgacagcacagtatcttagagggaaaggaaatgtaggatgccagtgtggggacaaatttctgattgccagtgattgttgtgagcataacaataatttcatgaacattaaagcctctattgagggcagctgcagttgtaaaggaaaaaaaatggtcctgaacatttaaaactacactggtgtacatcataatcaaacaaagtaaacagaaaaaaatttaaactttgctaaaaaaaaaaagcagaagcacttgatctttaggaaggcacgcagttgcttattatgaatcatttctagagtccgatgcattttcaaagccggttacagtcattacgaagcacacccttgtgaggtaagtgtatcatcacctttggttcataaataaaaaagctgagacgccgagcgattaagtcactcgcctaaggagaatgagtcaacgtcaagagtcatagttgacccggcctaaagactccagaccatcagtccagggcttagtcagcggggcccggagtggcttccctggctggcatctggacttaggctatttccgtgcacgtaaaagcggaatattggaacggttgcacagaacttccaaataatttttaccgccacgcaagatttagccctgaggtcttaatctcaggatttgggacagtaaaagctgtcgtccctccccctcgtccagccggtggcaagcgggtactgcgggcggttccgtccgtcccctttcgcagaaatggcaacgaatgaccaccagcattagctgagccaggggacgtgggagggttgattgcctaaacgactctgcatcgccgcctctttttgaaactaagagaaaatggtgggagatcaaaagaaaactaaataaacacacaggcaacttgtcctgggacctcaactaagcaaatgaagccttattgtgtgtgctgagcctgcagttcccaaccttccggggaagatgggaggacagggcgacaaagggcacagtaggcttgcctggcagtaagtgtgaccgcagctatccaggcggaagagcagaggactgaaaccaccctccagcaagcgagtgtccgccgcgttgagaaccgcgcaccctacccatcggccacgtgaccagtcctttttaaaaaaaatttctttaccttaaaaacacaaacacaacaacaagggggggggagagactcccatttcccaaaagccctctggtaactcacgcagccgcagtcttgcgcaggt

SEQ ID NO: 335335 - DNA, 1402 bp, Homo sapiens
cgtcacgtggccagaagctggccaatccggtttgaatctcatttttttcctcttacccccccttctggagcggttgtgcgatcagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgc

SEQ ID NO: 335336 - DNA, 829 bp, Homo sapiens
  misc_feature (25)..(25): n is a, c, g, or t
  misc_feature (48)..(48): n is a, c, g, or t
gggagggccaggtcttgggattgangggttttggtctttttcccccgnaaatacgtgggtgagagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgc

SEQ ID NO: 335337 - DNA, 754 bp, Homo sapiens
  misc_feature (754)..(754): n is a, c, g, or t
cgtcacgtggccagaagctggccaatccggtttgaatctcatttttttcctcttacccccccttctggagcggttgtgcgatcagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaagaaggggggaaaatttgggggggcataaaacattttttggggggaaaagggggaccccccctttttttaaaacgtttttggtggggtttttttgggcggagaggaaggagaggagtgggccaaacacacacaacaagaacaccggggggggggggcgccaacaaacacaacaccacgttttttttttttgtgtggagcggggggacaaaccaaccaacaagagaggggggtggaggacacaacaaacagccacacgcacaaaagatgtcctgcacataccaaaagaactaagagaagaaatagaacatacaaaaaacaggagaagcgctataccgaagtgaagaggaaagataagaaccagcacacacagagan

SEQ ID NO: 335338 - DNA, 483 bp, Homo sapiens
aaaaaaaaaaagaattatcagcatatcagttcaggtttagttagaatattgctgtcatagatgtgttaagacatttaaaataatgttttatattattttccactaggaaaccacccctactcctaatcccccgactacagaagaggagaaaacggaatctaatcaggaggttgctaacccagaacactatattaaacatcccctacagaacagtaagctttctaacacctaggttttctgagttaggccacaaggtaaattgtgaatggggcaagtttgaagggaaagttagattatgagactagttttagatatgctaaggttgagggttctattttcacttggatgacccatgaccagcagacagttttatgtgtgagtcttgagttcaaaaggagctatgtgagagattagtttgaaaagtattggtcataatggaagccacattagtaaataagttcccttaaggagaagtgaacttga

SEQ ID NO: 335339 - DNA, 3323 bp, Homo sapiens
cgtcacgtggccagaagctggccaatccggtttgaatctcatttttttcctcttacccccccttctggagcggttgtgcgatcagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagcactgatttcattgtaaaattttaaagcagtttaaagggtaccacaggttatcacagtactctcaatgccacaaacacctcttgttcagtattctagaaatactgaatcagaattctgtgtttattataatctcagcatactgtacataatatctgctagttaaacttgggtaattggttaaggtgacttactgtctatgtcaatatgtatagttttgagtacttcaagagtttacttaaaagtgatgatgttactggtatgttggcagtgggtgggactgaagtagtgtatctattataaattgatctattttcttaattctaagatgaagtccaattttaagcatcagcttttaggtgcaaaggaggaattaacacattaaatgtatacagttctaaatttttgaaataactgatgtgtagcatttgattattggtattaccattttagaatcatgatgttattttaaacctttttcctggggacaagaaaggataataaattacgctgaatcacttttggcagttgccacttaaatagtacagtgacttgcaacttttataactttatcagcatcttctctaaatacaaaattaggctatatgttattttccaacttactgttttctctctgtttagcaggatattataaatagattaaatagatatattttctttttttttttttttttttgagacggagtctcgctttgtctcccaggctggagtgcagtggcgtgatctcccagtagctgggactacaagcacctgccaccatgcccggctaattttttttgtatttttagtagagacggggtttc

SEQ ID NO: 335340 - DNA, 2469 bp, Homo sapiens
ggccacgcgcgcgtccccgaagagggggacggggagcgagcgcacgggggagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagc

SEQ ID NO: 335341 - DNA, 2675 bp, Homo sapiens
ttgagggtgctgtgaggaaatgcatggtttgttgaaaagaactgaggactgacagccgcctcctccatgattaccctggctctctgtcccacccttctcatggcgcttgggggaccatggctgatcctgtcctgagacaaattaagactcctgtggtgaagcagttggtcgagaaaaagtgatgcatgaaaaagaagcaaaacaagaaggaaagaaaaaaaatgagagctgaagatggtgaaaatgatgccattaaaaagcaggcagaaagtctgcgagaatcccaggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagc

SEQ ID NO: 335342 - DNA, 2424 bp, Homo sapiens
  misc_feature (34)..(34): n is a, c, g, or t
gagcagatcgcatctaggatggcgatggtcgaancggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagc

SEQ ID NO: 335343 - DNA, 2539 bp, Homo sapiens
ggaatcatacagtatttgtcttttttggaggggggctggcttattcacttaatgtccttagcttcccctcatgttttatgaagtgttagaatttccttcatcagggctttttagtattccattgtgtgtatatatacatttttcattcatctgttgatggacaggtgggttgcttctaccttttgacttttgtgaataatgttgcttttaacatgggtatgcagctaccattttttgacactgattttttatttttagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagc

SEQ ID NO: 335344 - DNA, 2448 bp, Homo sapiens
cgtcacgtggccagaagctggccaatccggtttgaatctcatttttttcctcttacccccccttctggagcggttgtgcgatcagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagc

SEQ ID NO: 335345 - DNA, 2415 bp, Homo sapiens
ggccacgcgcgcgtccccgaagagggggacggggagcgagcgcacgggggagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagc

SEQ ID NO: 335346 - DNA, 1735 bp, Homo sapiens
ctgggcagaatatgggcccccacgcactgacacttccaataatatggtttacacaggttcccggtcagggtcttttggtttaacacgtaacccgcgcaatgcgttttgggcctttaaaaaatggggttttataaaaaacctttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagc

SEQ ID NO: 335347 - DNA, 322 bp, Homo sapiens
aaatggagtctcactgtgtcgcccaagctagagtacagtggcgcgatctcggctcactgcaacctccgcctcctgggttcaagtgattctcctgcttcagcctcctgagtagctgggactacaggaaaccacccctactcctaatcccccgactacagaagaggagaaaacggaatctaatcaggaggttgctaacccagaacactatattaaacatcccctacagaacagtaagctgctacagcattttttggactcctgccagctacccagtacaatactatgtatgtaatttaatgtataatgcatgtaatttatactg

SEQ ID NO: 335348 - DNA, 1915 bp, Homo sapiens
cgtcacgtggccagaagctggccaatccggtttgaatctcatttttttcctcttacccccccttctggagcggttgtgcgatcagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaatta

SEQ ID NO: 335349 - DNA, 2502 bp, Homo sapiens
cgtcacgtggccagaagctggccaatccggtttgaatctcatttttttcctcttacccccccttctggagcggttgtgcgatcagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagc

SEQ ID NO: 335350 - DNA, 1721 bp, Homo sapiens
cgtcacgtggccagaagctggccaatccggtttgaatctcatttttttcctcttacccccccttctggagcggttgtgcgatcagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagac

SEQ ID NO: 335351 - DNA, 898 bp, Homo sapiens
cgtcacgtggccagaagctggccaatccggtttgaatctcatttttttcctcttacccccccttctggagcggttgtgcgatcagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtatttctctatattatgtcttcttttgtggtgtcttccatgtgaacagcataagtttggagcactagtttgattattatgtttattacaatttttaataaattgaataggtagtatcatatatatggaatta

SEQ ID NO: 335352 - DNA, 2512 bp, Homo sapiens
aaatggagtctcactgtgtcgcccaagctagagtacagtggcgcgatctcggctcactgcaacctccgcctcctgggttcaagtgattctcctgcttcagcctcctgagtagctgggactacaggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagc

SEQ ID NO: 335353 - DNA, 2395 bp, Homo sapiens
cgtcacgtggccagaagctggccaatccggtttgaatctcatttttttcctcttacccccccttctggagcggttgtgcgatcagatcgatctaagatggcgactgtcgaaccgatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagc

SEQ ID NO: 335354 - DNA, 2437 bp, Homo sapiens
ttgtcttaagaaattgccacagccaccccaatcttcagcaaccactactctgatcagtcagcagcaaacaagggaagaccctccatcagcaagattaccactctttgtaggctcagatgatcgttagcatttttagcaatagaatttttaattaagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagc

SEQ ID NO: 335355 - DNA, 2595 bp, Homo sapiens
cgtcacgtggccagaagctggccaatccggtttgaatctcatttttttcctcttacccccccttctggagcggttgtgcgatcagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacaagatgggatcttgctatgttgcccaggttggtctcaaacttctggcctcaagtgatcctcccacttcagcctcccaaagtgctggaattacagcttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagc

SEQ ID NO: 335356 - DNA, 2284 bp, Homo sapiens
  misc_feature (34)..(34): n is a, c, g, or t
gagcagatcgcatctaggatggcgatggtcgaancggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacagagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagc

SEQ ID NO: 335357 - DNA, 2050 bp, Homo sapiens
gcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggccccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgtcagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgcc

SEQ ID NO: 335358 - DNA, 2086 bp, Homo sapiens
  misc_feature (2069)..(2069): n is a, c, g, or t
  misc_feature (2072)..(2072): n is a, c, g, or t
  misc_feature (2083)..(2083): n is a, c, g, or t
  misc_feature (2085)..(2085): n is a, c, g, or t
ggagggtgcgagtaggctggagtacaccagggagttcccagcaggccactaggagccacccaggatgcccggcaacctcatgagtcagacaagcagggctgtgtctatctggaagtttccagccaagctaggtaaaacacatggacacagggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggccccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgtcagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgccaaaaaaaaaaaacctgcagcccgggggnccnctagttttagngng

SEQ ID NO: 335359 - DNA, 2034 bp, Homo sapiens
  misc_feature (2017)..(2017): n is a, c, g, or t
  misc_feature (2020)..(2020): n is a, c, g, or t
  misc_feature (2031)..(2031): n is a, c, g, or t
  misc_feature (2033)..(2033): n is a, c, g, or t
gcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaccccctggggccccccacacagaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggccccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgtcagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgccaaaaaaaaaaaacctgcagcccgggggnccnctagttttagngng

SEQ ID NO: 335360 - DNA, 2245 bp, Homo sapiens
  misc_feature (2228)..(2228): n is a, c, g, or t
  misc_feature (2231)..(2231): n is a, c, g, or t
  misc_feature (2242)..(2242): n is a, c, g, or t
  misc_feature (2244)..(2244): n is a, c, g, or t
gcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggccccacaggtttccccaaggcctctcaccccacttcccatctccagggaactgttagaaatgttagtgccccgcatgttgccccaagttctaggccccccagaaagctgtcagagccggccgccttctcccctctcccagggatgctctttgtaaatatcggatgggtgtgggagtgaggggttacctccctcgccccaagcttccagaggccctaggcgggatgggctcgctgaacctcgaggaactccaggacgaggaggacatgggacctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgtcagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgccaaaaaaaaaaaacctgcagcccgggggnccnctagttttagngng

SEQ ID NO: 335361 - DNA, 2412 bp, Homo sapiens
gcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggccccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgtcagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgccaaaagaaaacacaaaggagagaaaagagagagagacagacaaagcacaacgagagaaagaagggagaggagaagagcaaagaaaagaggccaggaagcaaaggacgaacaacacagaagggggggcgccacatatggaaaaaccccaccaagggcggcaccaaaaacaagccgcacaccaagtaagtggagaaccaaagagggcggccacacaaaaagagagacagcgctcgatcaaacaaacacgacaagaacgggagcacgcgccgcgcaaaacagaaggggtacgagagcgggagggacaacaaacagacagagcgagcgagcaacggtgcgagagagaaaccacaaaaaaagagaggg

SEQ ID NO: 335362 - DNA, 1468 bp, Homo sapiens
  misc_feature (1451)..(1451): n is a, c, g, or t
  misc_feature (1454)..(1454): n is a, c, g, or t
  misc_feature (1465)..(1465): n is a, c, g, or t
  misc_feature (1467)..(1467): n is a, c, g, or t
gcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattccctgggggtgcagatggtactgctgaggtcccgggcttagtgtgagcatcttgccagcctcaggcttgagggagggctgggctagaaagaccactggcagaaacaggaggctccggccccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgtcagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgccaaaaaaaaaaaacctgcagcccgggggnccnctagttttagngng

SEQ ID NO: 335363 - DNA, 1800 bp, Homo sapiens
  misc_feature (1783)..(1783): n is a, c, g, or t
  misc_feature (1786)..(1786): n is a, c, g, or t
  misc_feature (1797)..(1797): n is a, c, g, or t
  misc_feature (1799)..(1799): n is a, c, g, or t
gcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccatccctgaagacgagcatccccctcctctccctgttagaaatgttagtgccccgcactgtgccccaagttctaggccccccagaaagctgtcagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgccaaaaaaaaaaaacctgcagcccgggggnccnctagttttagngng

SEQ ID NO: 335364 - DNA, 927 bp, Homo sapiens
  misc_feature (910)..(910): n is a, c, g, or t
  misc_feature (913)..(913): n is a, c, g, or t
  misc_feature (924)..(924): n is a, c, g, or t
  misc_feature (926)..(926): n is a, c, g, or t
cggtccacgagttcggagttgagactgcagtaaaccgagattgtgccactgcactcagcgtgggctggaccagtgagaccctgtctcagctcagtgagaccagtaagaccctgtctcaatcaatcaatcaatgcagtgagttagagagcatctattgagcatctacggtttgcgggtcacttccagcaccattttgagatgcggaaactggctgaagttgggtgattgattgaccaagttcctttgggaaattaataaagtcacactgaagcaataaactaccctcctcccaaacacccccaagaccatccctgaagacgagcatccccctcctctccctgttagaaatgttagtgccccgcactgtgccccaagttctaggccccccagaaagctgtcagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgccaaaaaaaaaaaacctgcagcccgggggnccnctagttttagngng

SEQ ID NO: 335365 - DNA, 1654 bp, Homo sapiens
gcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggccccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgtcagagccggccgcgctagggtcctggaactagggcgaagtcacacattccatgtcaggacaggacccagtggaagactggctcgcgag

SEQ ID NO: 335366 - DNA, 1393 bp, Homo sapiens
gcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggccccacaggtttccccaaggcctctcaccccacttcccatctccagggaatggctgccagcccactgcctcctgcctggggtggcctggccctcctggctgttgcgacgcgggcttctggagcttgtcaccattggacagtctccctgatggaccctcagtcttctcatgaataaattccttcaacgcc

SEQ ID NO: 335367 - DNA, 662 bp, Homo sapiens
gcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatctggctgccagcccactgcctcctgcctggggtggcctggccctcctggctgttgcgacgcgggcttctggagcttgtcaccattggacagtctccctgatggaccctcagtcttctcatgaataaattccttcaacgcc

SEQ ID NO: 335368 - DNA, 2095 bp, Homo sapiens
  misc_feature (2078)..(2078): n is a, c, g, or t
  misc_feature (2081)..(2081): n is a, c, g, or t
  misc_feature (2092)..(2092): n is a, c, g, or t
  misc_feature (2094)..(2094): n is a, c, g, or t
gcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggccccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgtcagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgccaaaaaaaaaaaacctgcagcccgggggnccnctagttttagngng

SEQ ID NO: 335369 - DNA, 1955 bp, Homo sapiens
  misc_feature (1938)..(1938): n is a, c, g, or t
  misc_feature (1941)..(1941): n is a, c, g, or t
  misc_feature (1952)..(1952): n is a, c, g, or t
  misc_feature (1954)..(1954): n is a, c, g, or t
gcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgtcagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgccaaaaaaaaaaaacctgcagcccgggggnccnctagttttagngng

SEQ ID NO: 335370 - DNA, 2510 bp, Homo sapiens
gcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggccccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgtcagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgccaaaaaaaaaaaaaaaaaaaaaaaaaaaaaaaaaaaaaaaaaaaaaaaaaaaaaaaaaaaaaaaaaaccacaacaaaaaaaaacaaaaaaaacaccaacacaactaaatcaaacacgcccccccccccaacaacagaaatcacaccacgacaaaggagagaaccatagaagaaacgcgagggcgtgcgtccacatcatctgtgctatcacacgaaacccagctcgccgccacacccaacaattaacaagccaccgcatcataataaccacacctaacacaaactacgcgacgatctcactcccacaacacaccaaactccaacacgtttaatacgccaaccatcaccacccgacaccacacgtcaccatacctcaaataacaaactaaacacgttacatatcaactaaacaccgcaccctcacattctataacgcaacaacactacccccagccacaaaag

SEQ ID NO: 335371 - DNA, 2355 bp, Homo sapiens
gcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggccccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgtcagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgccaaaacaaacaacagcccacacaaacacccacaaagccaaccacacaacgaaaaaaaaaaaagggcgcgggggcgccaactaaagacacccagcgagagggggcacaagaaaaaggagcaccagaagacactacaagagagaaggggcggccaaaaaaagagggcgactacaggaagaaaggagcgcaccagcgcggaggaaacgaggcggcgcggggcgagcaccaacaagcgagaggaagatattaggcgagggacaccaccacaccaggagcaccgacacaagcggcacacacccccgcgcgg

SEQ ID NO: 335372 - DNA, 2019 bp, Homo sapiens
gcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggccccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgtcagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggcctggccctcctggctgttgcgacgcgggcttctggagcttgtcaccattggacagtctccctgatggaccctcagtcttctcatgaataaattccttcaacgcc

SEQ ID NO: 335373 - DNA, 1540 bp, Homo sapiens
gcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggccccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaacccccctagacaagacgtgcagtacgaatatgtcacagcgctgggcctttgagtcaagtaatccctcgaggactgac

SEQ ID NO: 335374 - DNA, 1364 bp, Homo sapiens
gcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggccccacaggtttccccaaggcctctcaccccacttcccatctccagggaagctacaggtgaatttaatcctctggttgacgattgagtccttgagtttgtctaaagacctgggattggtagaaaggggttgttcaggttaaaataaagattatggagacc

SEQ ID NO: 335375 - DNA, 848 bp, Homo sapiens
gcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcagcacgggattggtggatacaggactgactggagtgccacagcatgtccccgtgcgccttgtcactgtggacggcggcgggggccttggtggaggtgacacgagcatgtcggcctgcagagtctgacaatcaacaggtcctgcaaggtgtctgacagcctgtgatgacgtgtacgtggctggcaaggcagagccagaggagcccggggtggtgcgagtg

SEQ ID NO: 335376 - DNA, 651 bp, Homo sapiens
aaagaagtgggaggacggactcatggtgagtcttgtggggacatgtttgctggaggctaaccagcctgatcatgacatcttcatcttaaatttgaaaattgtcatcaggttacggtgaaatcctaccggatcaacatctgagaccaggcttatggaagtgagcttccaacctgaatgcttgaggctgagggggtgttggcggcctcgataacaacctgaacaacagctggcagcagggagtgcctgggccatgtgtccccagagcactgacctgggtggtccagtctcctgtctcgagctccagccatgagcttacacggccttcacactccccccaaaaccagccattctcaaccagcgaggcctctgtgtctgcaaggccagttttatttcttctttgatatttctgcttctgtgtcctttccccgctgcccaaaagctgcctcccgtctgcccatgcagagctgtattacccaacaacacccagctcgactcggacagcacccagctcaactcggacaggccccgggaaagtaagagcttggggggagacccacaggcccacacggcagcactgcgaggctagaccgtaaacatgggtcaattgaatatttataaacaggatacttaaaggttcttgggatattgaac

SEQ ID NO: 335377 - DNA, 198 bp, Homo sapiens
gccaggtgccctggcactcccaagcaattaaggccagctggcatcatagccttcccatccacccctactcactgaccccgtccccccgtcccacccaccgcagtggacagctgcctgaatccactaatctggggctgggtgggtgtttcctgcatgtttgagattttaggaggaaatcaaaataaagaaacaaagcct

SEQ ID NO: 335378 - DNA, 439 bp, Homo sapiens
cgctgtgttagacatccgtgagctagctgggaactacagatgcccaccaccacgtcagctaatgttactatttttagtagagacagggtttcaccgtgttgcccaggctggtctcaaactcctgaactcaggtaatccaccctccttggcctcccaaagtctgggattacaggtgcccaccaccacacctggctggtttttgtatttttaatagagacggggtttcaccctgttgttcaggctagtctcgaactcctgaccttaaatgatctgcctaccttggcctcccaaagtgctgggattacaggtctgagccactgtccccagctgaaaatcagatttttaaatgtttagcttcactgtccttataccaacagagctgttaaaggttttcagacgacccctcagaacttataaattatgttaaacaatgaacccc

SEQ ID NO: 335379 - DNA, 180 bp, Homo sapiens
ctgttttactgactcggctttgccttaagattttctttggaaaatgattctatccttcaaacaacaacatcaacaacaaagacaacggttttgaaaaccactgccccatacctgtgactagaagagttgtttaattccccctcccacccagccctgccccatggcgggtgtggggtatgg

SEQ ID NO: 335380 - DNA, 271 bp, Homo sapiens
tctgcttcccctctaatctgcctcacaccttcttctacacagccaaatagtcctttgaaagtgtaaatcggggctgggtgcggtgggtcacgcctgtaatcccagcactttgggaggccgaggagggtggatcacgaggtcaggagattgaggccatcctggctaacacagtgaaaccccgtctctactaaaactacaaaaaattaggcgggtgtggtggtgggcacctgtagtcccagctactcgggaggctgaggcaggagaatggtgg

SEQ ID NO: 335381 - DNA, 1092 bp, Homo sapiens
  misc_feature (716)..(716): n is a, c, g, or t
  misc_feature (721)..(721): n is a, c, g, or t
  misc_feature (747)..(747): n is a, c, g, or t
  misc_feature (751)..(751): n is a, c, g, or t
  misc_feature (779)..(779): n is a, c, g, or t
  misc_feature (982)..(982): n is a, c, g, or t
  misc_feature (1064)..(1064): n is a, c, g, or t
  misc_feature (1092)..(1092): n is a, c, g, or t
ctcaggtatgccacgtgttgcaagctcatccctcggacctgtgaaaaaactccaacaattggattccggccctcaaaccccacacaggacttaattaaccttgccttcaaggtgtacaataatagagaagaggcagccaagtgacaaggcatctctgagttacagctactcgcctctgctgtaagacaacccacaaccacgtctccagcacacaaaaacttcagaacatccaagccacagttcccaggggctccttcaaaacctcctcgtggacctggcttcaaatgccaaaagcctggccactgggcctgagaatgcccacagctcgggattcctcctaggccgtgccctgtctgtgtgggcccccactggaggttggactgtccgactcacatcgccaccattcctaaagctcctggagctcaaacccaacgttccttggctgactccttcccacatctgctcggcttagcagctgaagaccgacactgcccaatcgccttggaagccccctggaccatcacagacgcgcgtgacagtccccagcactgcagagatctgagatccaataacagtctgcagaggtctactcacaccatagccactgctctgggattcccattccatttaggcctcctgattgccccatgtgtccttacaataaacaactggcctcgttggcctcagcggtggagctctgggccagttccttttangaggnctacccatgatctcgctactgactgntggnttggtcgtcgctgcgcgagcgactcacntcctacaacgcgtatactgttatcccaaatcagcgcatattagcaacacctctgacaacagccctatacgcaggatcgttaagcccggtgctgggtctcatagtccccccgtaattccaaattagccatgaagcggacacaagactaagacacgttacctgactctcagctattgccgctcctcgaaattcgtttcctggagnggcttatacgccagttcggggaaggtttcacctggcgattatccaatgctcccatattacccacacaatgcgccacccgatnacgccgcgccctgtatctatcagacccn

SEQ ID NO: 335382 - DNA, 1210 bp, Homo sapiens
  misc_feature (834)..(834): n is a, c, g, or t
  misc_feature (839)..(839): n is a, c, g, or t
  misc_feature (865)..(865): n is a, c, g, or t
  misc_feature (869)..(869): n is a, c, g, or t
  misc_feature (897)..(897): n is a, c, g, or t
  misc_feature (1100)..(1100): n is a, c, g, or t
  misc_feature (1182)..(1182): n is a, c, g, or t
  misc_feature (1210)..(1210): n is a, c, g, or t
cacagacgtgcatggcatttggtgctgaagacccgggacaggaggactccttcgggaggcgggtcccctgtcctcgccctaactctgtgaggagatccacctacaacctcgggtcctcagaccaaccagcccaaggaacatctcaccaatttcaaattgggaaaaaactccaacaattggattccggccctcaaaccccacacaggacttaattaaccttgccttcaaggtgtacaataatagagaagaggcagccaagtgacaaggcatctctgagttacagctactcgcctctgctgtaagacaacccacaaccacgtctccagcacacaaaaacttcagaacatccaagccacagttcccaggggctccttcaaaacctcctcgtggacctggcttcaaatgccaaaagcctggccactgggcctgagaatgcccacagctcgggattcctcctaggccgtgccctgtctgtgtgggcccccactggaggttggactgtccgactcacatcgccaccattcctaaagctcctggagctcaaacccaacgttccttggctgactccttcccacatctgctcggcttagcagctgaagaccgacactgcccaatcgccttggaagccccctggaccatcacagacgcgcgtgacagtccccagcactgcagagatctgagatccaataacagtctgcagaggtctactcacaccatagccactgctctgggattcccattccatttaggcctcctgattgccccatgtgtccttacaataaacaactggcctcgttggcctcagcggtggagctctgggccagttccttttangaggnctacccatgatctcgctactgactgntggnttggtcgtcgctgcgcgagcgactcacntcctacaacgcgtatactgttatcccaaatcagcgcatattagcaacacctctgacaacagccctatacgcaggatcgttaagcccggtgctgggtctcatagtccccccgtaattccaaattagccatgaagcggacacaagactaagacacgttacctgactctcagctattgccgctcctcgaaattcgtttcctggagnggcttatacgccagttcggggaaggtttcacctggcgattatccaatgctcccatattacccacacaatgcgccacccgatnacgccgcgccctgtatctatcagacccn

SEQ ID NO: 335383 - DNA, 643 bp, Homo sapiens
tgtggtggctatttgagaggctgaggcaggagaatcatttgaacccaggaggtgaaggttgcagtgagccaagatcacaccattgcactccagtctgggtgacaagagcgaaactctatctcaaaaaaaagaaaaaagaaacaagatcttcaagcttaaggaaacaaaaacaaaactcagctgtgttaaatctgtttttagttgctatacatttctgctcagcttcatgtgatgcacattcatgtaattgtatcctaaattcctttgtactttttattttcttccttggtcttcaattatcttaagactaccaagaaaacaaaaattttaaaaatcttcttcagccggtcaggcgcagtggctcacggctgtaatcccagcacttggggaggctgaggcgggtggatcacgaggtcaggagttcaacaccagcctggccaacatggtgaaacgtcgtctctactaaaaatacaaaaattagctgggcattgtggcgcgttcttgtaatcccagctgctcaggaggctgaggcaggagaattgcttgaaccaggacccgggaggtgtaggttgcggtgagcggagatcgcgccactgcactccagcctgggctatagagtgagactccatttcaaaaaaaaaaa

SEQ ID NO: 335384 - DNA, 534 bp, Homo sapiens
agtttacacaacgctaaaaaagagaaattgtttcctaccattcaagtgtctcactggagggggtgggaggggagaagatattgtggtcagtgttatccaactaaagccaagttgtcaacatgcaatgggccaggattcacacgtgactgggccatgtgttaatgttacagggacaatttccaaactgctgtttggggtagccatctggttgagatgaagcactctggcaacttcctgtcattagagcctagtctcccttagacctgggccctctgcccaccaagggtgctgtgtggctgccctcagaccacaaaccaccagccctatgacacccaaaccatgaaatatatctcaggaggtaatagagtttagtgactagaaacagcactgaggttagattcaacgtctgacttaggagtgaacagctacaaaaacaaagaacaatctcagacaatatatcacagagaccatggcaactttggattttcctctctgggcctctacattgattttttgtttttttttcttttcttt

SEQ ID NO: 335385 - DNA, 134 bp, Homo sapiens
tgaggcagtatatggagaaacaccgagcaatgtacctggcacaggtgaggtgctcagtgaggatctgtggaaagattgaacaactctgtgctgacactgtatgctagcattgctagtcagcaccttcccttccc

SEQ ID NO: 335386 - DNA, 171 bp, Homo sapiens
cacgagggtccgcggcttcattcttgaagtcagcgagaccaagaacccatcagaaggaaccgatcagggacacagtttcttctggaggctgtcagggaagaatccatttccttgcctttcccagctttcagaggctgcgtatcttctttggcctgtggcgtcattctctat

SEQ ID NO: 335387 - DNA, 406 bp, Homo sapiens
tcacttttcacagcctctttaaaaccaattttaggatttatctctttcagacgtaaatcccaagacctggttttattataaataccttacctaatttatggtgatagaatgaattcatacttgtgactcaaaattcctttatggcaagaccttggtaataaaaataaaatcatgtttgtaccttctaaacaaaaatatgcttagtatcaaaaccttaacacgtttataggaattttatttttttccaaaggaaaaaaatcttaacaatattctgcaggaaatttctcatgcagtttgatttctttcagtgagataataagataatcacaaatgaaagtttatatctccccagcaacataccgcactaggagtctggaaggtagagtaggaagaacattccaatggg

SEQ ID NO: 335388 - DNA, 620 bp, Homo sapiens
agcggggagaaaagaagggagaagggaggagaaggaagatggaggaagaggaaggagagggagaaagaggaggaagaggagaaggaagaggaaagagaagagggagagggagagggagaggagggagagaaggagaggcgagcaggaagaagaggaggagtgagaagagaaagaagcatgggaggaagagaaggaatgagggtactcaccaggcagccttcccagcaggccccatgccctgcctaagaggcaggcgggagccgtcctcagcatctcccaatggccgagtacaggggtgcttctgcctcatcatgatgggcctggtctgagggctccagtcctgcctgggctgcaaggctgcatggctgcatgggctatgagccaagttcctgcctggcaggccgcactcgagagacccaccccactcccctgcaggggcagaggggctgggagaagaagatgtttaggtcctgccaggaaggtcctctcaccacaaattccacctttatgggaaaatcaatgttattacctcctccatcttcccacacttgctgctggtctaaagcaatcacctcatgggcactgagccagaactgagccagcgctctggggtcactggc

SEQ ID NO: 335389 - DNA, 1439 bp, Homo sapiens
aaggagcgccgcgtcacgatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgattttta

SEQ ID NO: 335390 - DNA, 1147 bp, Homo sapiens
acaaatgaattgtccgtgctttcctttcatgcacttatgtattaatgtgtcactttttgactagaggtgtgcttttgacacttaacctattttctattgaatataataagaagtgtgaaatgtaactaatagttcttaaaatgttaaatgaacagtaaatgttcagtggcgcacttcacattcaacttaagcatgataagtctatttggagtagagaaatgagattaccatatattctagaaccagcagaaaactatgtagttttcagttttttgagctgcatattctagtttcttttttttttttttttaatccaaatcaacaaagggattttttttttctagtttcagttttggcactggattttatcctggagttttaaaatattcttcatcctgttctttttctattaaggttaatgttgaagaaggaaaatgcggaagtcgtcatttgacaagttttataaatgagtatttgaagctcaggaataagtgaagctgaaatttgaaaaaataaaagaaagaatgcatgctaattatcagaccagaagtcccacttgtagaatattgagcaatttgtgtgaagtggggaagatgaaagaagtcagaatttgaaacggaagaatgaagaaaagaaataaaaatgaagttaagataagaagtaatctggaatcagaaagcactacgctaagtaattactagtctgtttatgtgtccctgtatattttgctaaacatgcatgcattatttgtttaatagaggaaaatatatacagggtaaagaagtgccttccaggggaaacgtttaaattaggtaattctgattttaactgcttagttaaatgattgaaatgcaatttttaaaaaatatttagtagtcaagcaccaggcagcagtgagctctccagcatgggtaacagtgggcttcatgttgtcctctctagataaactttacctgtctaatgttgctggtcctggggcatgagcgaatacctccagggttggaactggtggtctttgccacctccctggactcttagattgcactgtcccctttccttcagtactgagcaatgtatagtagaatattttctgttaaaccattttcaaaggaatgtcaccaggatggttatggaaccaaacccccaa

SEQ ID NO: 335391 - DNA, 778 bp, Homo sapiens
aggtataaagtataggtgtcatagttaataaggttccgcctcaccctagtctttatggagtaacattctgaaacacagtccttggacagttcccttaactgcttgactttggcacccctttctgaaggaagtggggtcaaataactcttatccctgctccaaaaaggtggaagaaaggacaagttaattgacttatgtcatttggagcaatgaaactattaacaccaggtatattcagttcctgcccttacctatattttcttatcttggaaggggattgctgtccctcaccatttatctcacagcagcttatttgtttttaaagttgcccagaaagtgtgcaaattaaacttttaacatctacgtgtaggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtaagaaagactgtcttgagatttatggtgagggacagcaatccccttccaagataagaaaatataggtaagggcaggaactgaatatacctggtgtaaatagtttgattgctccaaatgacataagtcaattaacttgtaccaaacttccacctttttggagcagggataagagttatttgaccccacttccttcaagaaaggggttgcaaagtcaagcagttaagggaactgtccaagggactgtgttccagaatgttactccatacagact

SEQ ID NO: 335392 - DNA, 318 bp, Homo sapiens
agacagagtcactctatctttcagcctatgagtgcagcctcttgatcttggctcactgcaacctctgtctgctgggattataggcgttgagccaccgcacccagccaggaattttcttttacaaaactctcttaacatagttcacaaaatttaaaaagtaagtagattaaaatatagcaaggattatttgaccttaaagttattaagagtgcttatttgacacttgggcctgataatgtgcttcattctcaagatttaaacagaccttgaaggttcatgcagctttccttttttggggaactgatgaaagggcagtat

SEQ ID NO: 335393 - DNA, 2043 bp, Homo sapiens
aaggagcgccgcgtcacgatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaatgttggtgcagctgttcaca

SEQ ID NO: 335394 - DNA, 2299 bp, Homo sapiens
aaggagcgccgcgtcacgatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggttaatgttgaagaaggaaaatgcggaagtcgtcatttgacaagttttataaatgagtatttgaagctcaggaataagtgaagctgaaatttgaaaaaataaaagaaagaatgcatgctaattatcagaccagaagtcccacttgtagaatattgagcaatttgtgtgaagtggggaagatgaaagaagtcagaatttgaaacggaagaatgaagaaaagaaataaaaatgaagttaagataagaagtaatctggaatcagaaagcactacgctaagaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaa

SEQ ID NO: 335395 - DNA, 1963 bp, Homo sapiens
aaggagcgccgcgtcacgatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaa

SEQ ID NO: 335396 - DNA, 2492 bp, Homo sapiens
acaaatgaattgtccgtgctttcctttcatgcacttatgtattaatgtgtcactttttgactagaggtgtgcttttgacacttaacctattttctattgaatataataagaagtgtgaaatgtaactaatagttcttaaaatgttaaatgaacagtaaatgttcagtggcgcacttcacattcaacttaagcatgataagtctatttggagtagagaaatgagattaccatatattctagaaccagcagaaaactatgtagttttcagttttttgagctgcatattctagtttcttttttttttttttttaatccaaatcaacaaagggattttttttttctagtttcagttttggcactggattttatcctggagttttaaaatattcttcatcctgttctttttctattaaggttaatgttgaagaaggaaaatgcggaagtcgtcatttgacaagttttataaatgagtatttgaagctcaggaataagtgaagctgaaatttgaaaaaataaaagaaagaatgcatgctaattatcagaccagaagtcccacttgtagaatattgagcaatttgtgtgaagtggggaagatgaaagaagtcagaatttgaaacggaagaatgaagaaaagaaataaaaatgaagttaagataagaagtaatctggaatcagaaagcactacgctaagaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaa

SEQ ID NO: 335397 - DNA, 2172 bp, Homo sapiens
aggtataaagtataggtgtcatagttaataaggttccgcctcaccctagtctttatggagtaacattctgaaacacagtccttggacagttcccttaactgcttgactttggcacccctttctgaaggaagtggggtcaaataactcttatccctgctccaaaaaggtggaagaaaggacaagttaattgacttatgtcatttggagcaatgaaactattaacaccaggtatattcagttcctgcccttacctatattttcttatcttggaaggggattgctgtccctcaccatttatctcacagcagcttatttgtttttaaagttgcccagaaagtgtgcaaattaaacttttaacatctacgtgtaggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaa

SEQ ID NO: 335398 - DNA, 1903 bp, Homo sapiens
aaggagcgccgcgtcacgatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattaaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaa

SEQ ID NO: 335399 - DNA, 1889 bp, Homo sapiens
aaggagcgccgcgtcacgatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaa

SEQ ID NO: 335400 - DNA, 2355 bp, Homo sapiens
ctttcctcttgtcatctttttttgagacagggcctcactctgtcgcccagtctggagtgcagtggtgcaatctcagcttactgcagcttctaccttgcaggcttaagcgatccgcccacctcagcctcctgagtagctaggactagaggcatgccaccacacccagtaatttgttatatttttgtagagacatggggtctcactgtgttgcccaggctagtctcaaaactcctgagcttcaagcagtccaccagccttggcctcccagagtgtttggattacaagcatgagccactgcgcctggccaactcttgtttcttacgattgcaagctgtttatgacctgtaaaatggtttggtacgcatcccctcaggcttcgtttatgtacttacttgtgtattgtgtttctgaaaaaatcgaaccatacatgctcatctttttggcaattcagagcattctattgaatggaaggtgtgtcaacattacaattttttctagctgatagacacagtgtggttccagttatccttgtatgtcatgttatgaatatgtgaatttttcttagaataaattcatagaaggaaagatgccaagttgcttttcgccagcacgagtgcttgtttacctacttaattctaaggttgaaattttttcttttgcattctttcctacccattcccaaaaatacttgtagtacttgctgtaattttgtaatttctaagcagtgtttggtctaatcattatgtacttttcttgttagtgacattttggctagtatacagctccctttttaaacaactttgattttatgacaacttttccaaagtttaaaacttttttttttccctaggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaa

SEQ ID NO: 335401 - DNA, 1913 bp, Homo sapiens
aaggagcgccgcgtcacgatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcggtttaaaacttttttttttccctaggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaa

SEQ ID NO: 335402 - DNA, 1597 bp, Homo sapiens
aaggagcgccgcgtcacgatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttataggaatcaggaatttaataagaaggggggtcaaccttcttctttaactaatagggtcggtggagggactacccagaatctaaggtatccagaatctttcggaatcaatatattcaaactcggtccgggtatttaaaaaggcatgagaagagactttcttgagaaaactggggcgcctaagaagggtggggggaaatacttcggggtggcggggggggcaacttattttttttaattgtggtggttccttcgtggtgtttccaaaccacacggtggagaccacggggtggtcgcttaatggtggaggacggtgtaaggggtggagctttttttaacaaaccacttttttttttaaccacgcagtgctacgccttaacacctctttctgtggggggtggcggaccagctttggcagcaccacttggacggttggtgcttctccaaactttttcctgggcgacatccttggtcgcgttaccgcccaccagcggcggagggcgctactcggggcgcccccacagcagctttctaaacaagcggcgggcgtgtttccccacagaaccaacacagcgctactaggtctcctccggcgcacttgtgtatctttttgttaacagaccggggctcacaaac

SEQ ID NO: 335403 - DNA, 1340 bp, Homo sapiens
aaggagcgccgcgtcacgatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggcaggctgcgacgcacggagcgcagcgactggcacgcagctgcccaagacagggcatcagatccatagcacagcgcgcgtcacccttcttcctttactatacgtcgtggagcgactacacgatcaccgctccccagatcctccgatcatactcacctctgtcgctattaacaggcactgaagactttctgaaacctgtccctagaagctggcgaataattgttctgtgggccacatactttcacatatgtctcctcgtctcaaccacgtgacacagctgcctcgatggacgctcaggatgcactcacacacacccctctccaccgaactgacctacattcaggccgcgacgtcgatacatgctgctatacatacatgccattttgtgtaactttggtgccgagttccaagtttagtgattccatacca

SEQ ID NO: 335404 - DNA, 1586 bp, Homo sapiens
agtatggcttgctctgatgacagtgtattccctttatcagataatggattggtttcaggtagtttcatacctaatgattctccacacatcctgaacattttttggttcaagaaagtttgtggaaacaacccttagaatcctattattttttaagaaggaaaaattggacagcctcctgagccagagtaggctcggagactcctgttgtttctaactgaaatagtaaataatgtatttccaccatttacccagagtaggctcagagactcctgttgtttctaattgaaacagtaaataatgtatttccaccatttagtagcttttcaagagtccttaaaaatttttggacagcacagaaacatggattacttagccctttagttctcagattgagttatatacttcccagcaatttctgttatttaagattgctatctcatttctggtgtaatacttacatggaagtctttctctatttgggggtggtggggttctggcacataggaatttcttaatggcagaatattctgaaattctcggcattaaagtatacttgataattagttcacttaatattaaagcatgttcattcttttcttcccaggtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaa

SEQ ID NO: 335405 - DNA, 770 bp, Homo sapiens
aaggagcgccgcgtcacgatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgccaagaagtaaaggccattacgaaactaaatagcagtaagtcagcatcccgtcatcgttggcccacagagaattatgaccatgtacggaaggtacgactat

SEQ ID NO: 335406 - DNA, 1067 bp, Homo sapiens
aaggagcgccgcgtcacgatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggttaatgttgaagaaggaaaatgcggaagtcgtcatttgacaagttttataaatgagtatttgaagctcaggaataagtgaagctgaaatttgaaaaaataaaagaaagaatgcatgctaattatcagaccagaagtcccacttgtagaatattgagcaatttgtgtgaagtggggaagatgaaagaagtcagaatttgaaacggaagaatgaagaaaagaaataaaaatgaagttaagataagaagtaatctggaatcagaaagcactacgctaagaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggtaagatgaaaaactggttttgaagcagtcaactgcctaaatttactttttcttaaagttagagctgattttgacaatagagctttagcagttggtgcgtgagtgaaatcttcagaggcttttttagtgttttgagagagtcttttaagttaatcttccatgacggggtctgcatttgggctgcctgtcaattaagcataatactgacacaatggtgtaactccttagcccatcaaaaaaaaaaacttccgactgcattactatactgtagta

SEQ ID NO: 335407 - DNA, 1002 bp, Homo sapiens
agtatggcttgctctgatgacagtgtattccctttatcagataatggattggtttcaggtagtttcatacctaatgattctccacacatcctgaacattttttggttcaagaaagtttgtggaaacaacccttagaatcctattattttttaagaaggaaaaattggacagcctcctgagccagagtaggctcggagactcctgttgtttctaactgaaatagtaaataatgtatttccaccatttacccagagtaggctcagagactcctgttgtttctaattgaaacagtaaataatgtatttccaccatttagtagcttttcaagagtccttaaaaatttttggacagcacagaaacatggattacttagccctttagttctcagattgagttatatacttcccagcaatttctgttatttaagattgctatctcatttctggtgtaatacttacatggaagtctttctctatttgggggtggtggggttctggcacataggaatttcttaatggcagaatattctgaaattctcggcattaaagtatacttgataattagttcacttaatattaaagcatgttcattcttttcttcccaggtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgattttta

SEQ ID NO: 335408 - DNA, 954 bp, Homo sapiens
aaggagcgccgcgtcacgatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggttaatgttgaagaaggaaaatgcggaagtcgtcatttgacaagttttataaatgagtatttgaagctcaggaataagtgaagctgaaatttgaaaaaataaaagaaagaatgcatgctaattatcagaccagaagtcccacttgtagaatattgagcaatttgtgtgaagtggggaagatgaaagaagtcagaatttgaaacggaagaatgaagaaaagaaataaaaatgaagttaagataagaagtaatctggaatcagaaagcactacgctaagtaattactagtctgtttatgtgtccctgtatattttgctaaacatgcatgcattatttgtttaatagaggaaaatatatacagggtaaagaagtgccttccaggggaaacgtttaaattaggtaattctgattttaactgcttagttaaatgattgaaatgcaatttttaaaaaatatttagtagtcaagcaccaggcagcagtgagctctccagcatgggtaacagtgggcttcatgttgtcctctctagataaactttacctgtctaatgttgctggtcctggggcatgagcgaatacctccagggttggaactggtggtctttgccacctccctggactcttagattgcactgtcccctttccttcagtactgagcaatgtatagtagaatattttctgttaaaccattttcaaaggaatgtcaccaggatggttatggaaccaaacccccaa

SEQ ID NO: 335409 - DNA, 568 bp, Homo sapiens
agttgaaatgactaaataattagagaagaaaagtattgatcctactaaattggtaaccatgttagcatattcctggattgttccctcttttggagtttaactttagaacagagtaataaagaagacaatatttgttttcagtcataaccttaggaggtctttgtcttgcaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggtaagatgaaaaactggttttgaagcagtcaactgcctaaatttactttttcttaaagttagagctgattttgacaatagagctttagcagttggtgcgtgagtgaaatcttcagaggcttttttagtgttttgagagagtcttttaagttaatcttccatgacggggtctgcatttgggctgcctgtcaattaagcataatactgacacaatggtgtaactccttagcccatc

SEQ ID NO: 335410 - DNA, 561 bp, Homo sapiens
ctcctgccttggcctcccaaagtgctgggattataggcgttgagccaccgcacccagccaggaattttcttttacaaaactctcttaacatagttcacaaaatttaaaaagtaagtagattaaaatatagcaaggattatttgaccttaaagttattaagagtgcttatttgacacttgggcctgataatgtgcttcattctcaagatttaaacagaccttgaaggttcatgcagctttccttttttggggaactgatgaaagggcagtatatatagtcataaatttatatgtttggtctaattgtgatctattgagacttagacaatcttgacatttgtttataaaggcggtcaccttctccttactatagtcgtggaggatacagatcacgttccagatctcgatcatactcacctcgtaagtttttatcttaatatgattgtttatattgtagtatggcttgctctgatgacagtgtattccctttatcagataatggattggtttcaggtagtttcatacctaatgattctccacacatcctgaacattttttggtt

SEQ ID NO: 335411 - DNA, 2023 bp, Homo sapiens
aaggagcgccgcgtcacgatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaa

SEQ ID NO: 335412 - DNA, 2065 bp, Homo sapiens
aaggagcgccgcgtcacgatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaaaaaaaaaaaaaaaaaaaaaaaaaaacaaaaaaaaaaaaacaa

SEQ ID NO: 335413 - DNA, 2023 bp, Homo sapiens
  misc_feature (1503)..(1503): n is a, c, g, or t
  misc_feature (1531)..(1531): n is a, c, g, or t
  misc_feature (1540)..(1540): n is a, c, g, or t
  misc_feature (1548)..(1548): n is a, c, g, or t
  misc_feature (1562)..(1562): n is a, c, g, or t
  misc_feature (1564)..(1565): n is a, c, g, or t
  misc_feature (1569)..(1569): n is a, c, g, or t
  misc_feature (1571)..(1571): n is a, c, g, or t
  misc_feature (1574)..(1574): n is a, c, g, or t
aaggagcgccgcgtcacgatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaacccaaacncaaccccccccccccccccccccccccnccccccccncccccccncccccccaactaantnnccananccnccctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaa

SEQ ID NO: 335414 - DNA, 3172 bp, Homo sapiens
tttggggcctcttaagatggaaactaatccaaggccgactaagttctgggcccgttaggtggaggggattgcgtgagggctttgtgtttggcctaaatgaagcgcttttctctgatgccgaaagggcttcccaggcaaaaatctgtatcagtattctattaggacagaccacaaagtcgttaagatgattttgtggacatcgcatttccacgggattgtgaaggagaaattggcgggcaaccatttacggcgccgttatttcctttgttttgaggcgttctaatacttagaaccacagcgtgtgttggctacagttttctttcccttaagtttccacctcttaaaggtgttcagtgagggttgattgaattgcgggaacaagacagttctagggtttaaacagcatacgtagctggtctgtggggctctgggtattggattcggaaagcattgaatgatgcgaacatacgaggcttgctagaattaagaggaatctgttagaagggtgatagaaaagcaccatagaaattgatttttgaggctgtgggaataatttgtgcttttttaaaaaaaaaaaacaatttgttacctaagtttccccttgttggtaaagctaccttaagatctgaatatgatttatcaggtaaataagactattaaatgtcttagcaaacttttgattaagattttatatgattcctcagagtattttaggaagaaattttcagtgatgaagcgtgagtttcctgcgtaattttggagcccaaactgcttaatttggtttgaactaatcaagccttgcgtttacatactcggatgagcatagagtttttagtttttgatgtttttcccgaagccgattgactccaatgtcacgagtgttttagatttttttttaagttcttgctttcttgggtaagaaagttgggattgagctcaaaagttgttaaaaagtcgtgacttctgatcattggcagttgaatctgttataacagtcattggtgtttggactgcaaaaatgctttaatattgtggatattgtctggaactagaacgtgacattttcaagctgacattacaggtgattttataaggttaatgttgaagaaggaaaatgcggaagtcgtcatttgacaagttttataaatgagtatttgaagctcaggaataagtgaagctgaaatttgaaaaaataaaagaaagaatgcatgctaattatcagaccagaagtcccacttgtagaatattgagcaatttgtgtgaagtggggaagatgaaagaagtcagaatttgaaacggaagaatgaagaaaagaaataaaaatgaagttaagataagaagtaatctggaatcagaaagcactacgctaagaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaa

SEQ ID NO: 335415 - DNA, 2246 bp, Homo sapiens
taggaggaaattgttttgtattgtgagtctggttaggtttatcagtctcttgaaacccggttgaaatatttttttcttggttttaaacaagaatgctttaatattgtggatattgtctggaactagaacgtgacattttcaagctgacattacaggtgattttataaggttaatgttgaagaaggaaaatgcggaagtcgtcatttgacaagttttataaatgagtatttgaagctcaggaataagtgaagctgaaatttgaaaaaataaaagaaagaatgcatgctaattatcagaccagaagtcccacttgtagaatattgagcaatttgtgtgaagtggggaagatgaaagaagtcagaatttgaaacggaagaatgaagaaaagaaataaaaatgaagttaagataagaagtaatctggaatcagaaagcactacgctaagaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaa

SEQ ID NO: 335416 - DNA, 1481 bp, Homo sapiens
aaggagcgccgcgtcacgatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttaaaaaaaaaaaaaaaaaaaaaaaaaacaaaaaaaaaaaaacaa

SEQ ID NO: 335417 - DNA, 1689 bp, Homo sapiens
ctgacatacgctctagacggggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaa

SEQ ID NO: 335418 - DNA, 1376 bp, Homo sapiens
gaggacttatccccggatctgggtacaagcaagttcgtctctgctcagcctcctgagcaggctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaa

SEQ ID NO: 335419 - DNA, 1301 bp, Homo sapiens
aaggagcgccgcgtcacgatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggacgatgagtataggcgactaacctaccgagcctggcgatatctgggtgtccaacatagaatcttaattcaactttaaatttgcccacagaaccctctaaataccgttgtaaatttaactgctagttcaaagaggaacagctctttggacactaagatataaccttgtttagagagttaaaaatttaacacccatattatgcctaaaagcgggcaccgatttataaagcgttcaagctcaacacccacttatttaaaaaaccccatacatttaaatgaacaacttaaaccaaataggccaagcgatcaccctaatttaagaaccagtggtagtgtttagtcacatggcattattattcagcttattcttgctttgattct

SEQ ID NO: 335420 - DNA, 791 bp, Homo sapiens
aaggagcgccgcgtcacgatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggtaagatgaaaaactggttttgaagcagtcaactgcctaaatttactttttcttaaagttagagctgattttgacaatagagctttagcagttggtgcgtgagtgaaatcttcagaggcttttttagtgttttgagagagtcttttaagttaatcttccatgacggggtctgcatttgggctgcctgtcaattaagcataatactgacacaatggtgtaactccttagcccatcaaaaaaaaaaacttccgactgcattactatactgtagta

SEQ ID NO: 335421 - DNA, 353 bp, Homo sapiens
tggggtgcgggaggctggagaagaatgacgactggggtgcgggaggctggagaagaatgacgactggggtgcgggaggctggagaagaatgacgactggggctgcgggaggctggagaaaaacgacgactgggctgcgggaggcaagagggcggaggaatcaagcatgactgtcaggtttctggcttgtgtaagtggcagacggtgccatgtatgaaaaatggggaaaacctgggaaaaatatatttgggggaatcaagagttttataatagaaatgatacccttgaaatgcttactcaagtggaaatatcaagtaggctattgaatttacaaatctagagctcagaggacag

SEQ ID NO: 335422 - DNA, 258 bp, Homo sapiens
caaaggtagtataggccttggttgaattctaattagtataaaattagatgacactaattatcatctaataaattaggtttattagatgatatctaatagatgatatctaggctgggtattcttagatgatatcaaggaattattgtttaatttgttaggtgtgataatggcattgtggattttaaaacaagttattggccgggcgtggtagctcatgcctgtaatcctaacactttgggagaccgaagcgggcagatc

SEQ ID NO: 335423 - DNA, 662 bp, Homo sapiens
cactccgattcgcctcagaactgctggtgctggcccaggccaggctttgggcactgtgtgagggaggggtttgagaaaagcccattctggtgcaggaatagcactcaaagacttctggtgaaccctccgagactcccaggagcctggacatgttcccagcccagcatgactagtggcatgagtaagtgtggatacctggtggatacctggcttgggtgccaacgcctggaaaggggctggcaggtccatccctgagggctggggccacggccacctgctagccctgggacacagagtattaatacatcactcacactgagcctcagtttccccctctgtaaggtgagctctagcatctacctcctaggtgtgaagactaaatgagatgcctcctctgtctgcactccgctgtaaccctagttcctagaataccaccttgccccagcaggatctcccgaaatatgtgtgaaaggcacctgcataaagcacccagtgcagggccagaaacccagtgacctctcagccgggtgtccactggaggcacactgactgcattgtgctgctgcagtttccactgtctccacctttccaacatcatctgaccactctgcccctctgagagctctggaaacacacttatggcatccagtgacccctcaacc

SEQ ID NO: 335424 - DNA, 153 bp, Homo sapiens
gttttccaggtgagcttctcaagcaggataaattcctgcagaagcacagaaatctcaggagtcccaaggttcctagcaaattagaatcttgaggtaggagaggagccaggccccaccccagaagcccagtaggaactggcaccaagagaaaat

SEQ ID NO: 335425 - DNA, 184 bp, Homo sapiens
ttttttttttaaattccactgacaataatatttcactattacaaatatttcactgtaacaaaaaaatatattttgggtgagattttccttactttcaactaattcatattttagcagagacttgacatccctcagaaattacatgtgtatgtgcagtgtctatgtctgtgtgtatgtgtgtttg

SEQ ID NO: 335426 - DNA, 446 bp, Homo sapiens
ttttgctcagtcgttcaggctggagtgcagtggcgcgatctcggctcactgcaacctccgcctcccgggttcaagcgactctcccgcctcagcctcccaagtagctgggattataggtgcccgccaccacgcccaactactttttttgtatttttagtagaggcagggtttcaccatgttgatcaggctggtctcgaactcctgacctcaggtaatccacccgcttctgcttcccaaagtgctgagattacaggtgtgagccaccgcgcccggccctcttccgtttattctttgcctactcagtaatcttttctacactcgcctataactgctgaggacccctcgatatgtatcaccagaccagatcgtctggaagtccctcagtattttcagctaatgaacactttcacctgtgtatagggcagacacttcaaatcccacgtgtc

SEQ ID NO: 335427 - DNA, 606 bp, Homo sapiens
ccagatcattcattcgcttttgtaaaactcttcagcggtttccaattgcactttgaatcaatctgtaccccttaccctgcaaactgccacctgctgtggtccctgcccacttacccacctccactggatgcccctcgatacccagctcactgtgcctcggtcatgacgaccttctttttcttccttggatgcaccaaaaccagggggcctgaggacctttgcatgtgctgtttgtcccctttgcctggaatgctattctccaagatctttgcatagctggaaattttgtagctctaaacacggggttcttccatttcataagactataaagctagcaacctctggtatctggttaacagttcactttgtgcaggttattccagatgcagatagcatgggtttaggttttcatttagagaaccacctgacctctccgtagaaactcaccacattctctcccccagtgactttctaacacattacagtgttttaattttcttcatgtactcagcactacttgaagttttctcatgtatttgttgacagtttatctccacccactagaaggtaactctggccagggttacagcactagttctaaccagt

SEQ ID NO: 335428 - DNA, 688 bp, Homo sapiens
tgaaaaatgctcactctttaaaatatgcatagaattgcctgggtcatccagagagctcttccataataagacttcagagaggatgctgcatactgctggcttgagagtcctgacttgagggcatataaacatctagtaagccttccttacacagcttcttctccacttaactggccttaaatttttttaacctcttggatttaacataaatttgaaaacttaggctttactattcctagtcatgaaatagaaggtgggaaagaatgtccaggaaaggctctgattaacactggacaagctaatccagccgctcgtggttttattcatcattaaaaggatttaaactccgtaacctaggtgtttggtcaataattaaaggacagaccttcttactcacttcctcaagtgatagcaggagggcaagattttctagagaataaaacaaaatgtatgcaatagttttctttaagcccatgaaaatactagaggagtttataaacccatgaaatactgaaacatatttaagatgtgacttttggatctgtgactcttcttgactgactgataacatattttttctattttatttctttttttttcctgagctgctcctcccctcaactttcctaaatatgctcctgtctcatcttttggtcactttcaattcttttgccttttaggtatgaga

SEQ ID NO: 335429 - DNA, 513 bp, Homo sapiens
cttaaattatgagacctctttcactgagcatagagttagaaccatgagagcatattattcctagtcatgaaatagaaggtgggaaagaatgtccaggaaaggctctgattaacactggacaagctaatccagccgctcgtggttttattcatcattaaaaggatttaaactccgtaacctaggtgtttggtcaataattaaaggacagaccttcttactcacttcctcaagtgatagcaggagggcaagattttctagagaataaaacaaaatgtatgcaatagttttctttaagcccatgaaaatactagaggagtttataaacccatgaaatactgaaacatatttaagatgtgacttttggatctgtgactcttcttgactgactgataacatattttttctattttatttctttttttttcctgagctgctcctcccctcaactttcctaaatatgctcctgtctcatcttttggtcactttcaattcttttgccttttaggtatgaga

SEQ ID NO: 335430 - DNA, 376 bp, Homo sapiens
ctggggaggaagagaacagatgcaatagaaggactagatcagagctgccagatactttcccagcagcacaaacgtcaacttacctagagttgtaaaactgacattttgcccaaaattcttaactttcagggtatttgggagctgttaggattggcaattcagattcaattcaaattatttttttctatagtcctagaagcctatgccccatcatgcagtaaatatgatgtaaatatttgtagaaagaaagcaaaatgcctctgaaggtatcttctccagtatctcctactcaccagaatctcactacagcttaggtagcctccccaccaacccttttcttgcctttttctttgctgcttccctccaacctttgcct

SEQ ID NO: 335431 - DNA, 550 bp, Homo sapiens
cgtgggtcgatttcagggaaagatcaatattttgattgatcccacttggggagtcagactgtcagtacaacaacaaataatcaccatggggtgatttcaggaaggggtcaatatttcaaaagagcaggggatgtgacagagtaggtgagacaggggctagacacagaggccaaggatgatcttgtatacgaggtgacatctgagctaagacctgctcaggaagacaggggaagtcaggaagagggcattctgggcagtgggcacaggccactatgtcctagtcccaccccagtctactctgggtccctagcagtactcgtgcaaaggtcctggggcaagggtgagcttggcctgtttgagaaagagagaagtatcttcatctggaaaaaatatggctaacaaaagtattcatgcccttgggttgttctgaggactagatgagctgagtgtacggagaccttagtggagtgtccggcagtaaatgctggctatgtattatggttccaaaggttgttgctagagggcacaccccaccctaaatgggtcccta

SEQ ID NO: 335432 - DNA, 504 bp, Homo sapiens
ctaggatctacacattaagaaacatagacatgaacgtctccatggaaagactgggaaaatggattgcaggttctagcaggatgtcataataaatggtgcatatccagagtgcaagatgattcagtctcaccaagaacactgaaagtcacatggctaccagcattattgtgataagaactactgttttgggagatagtttagcaaaggtgccatgtagaaattgattaagtcagaggtatctttaacttgccaccacagagaagagattaatttcatatacttccattgagaagagagataagaatacaaaaccaagctgatttgcaggagtaaacttgatattcaaatactatttcctgaatgacattttctgagacatgctaattgtaattactttcagcttcaaaacataataaatttatctcatagtaagcatatagatggaataaataaaatgtgaacttaggtaaattataaattaataaagtatatttttaaaatttc

SEQ ID NO: 335433 - DNA, 501 bp, Homo sapiens
ccatgtaatgcatggcatacagagtgggttctttcctgtctaggcaccctcttttgaaaccaagtgtccatatagtttgagtattttcactgtggtttatcataagtacttagtatttcttgcttaactaatgccttataattattttttagagacagtcttgctctgtcaaccaggctggagtgcagtggcacaatcatagttcactataatcttggactcctgggctcaagcagtcctcccacgtcagtctcctgagtagctaagactataggtgcttgccaccacacccagttaattttaaaaattttgtgtagaggtgaggtctgtgttgcccaggctagttttgaactcctagtctcaagtgatcctcctgcctcagcttcccaagtagctgggtctacacgtatgtgccaccatgcctgtatttttaacatagcgatatggggtcttgccatcttgtccaggctggtcttgaactcctgttctcaagcagtcctc

SEQ ID NO: 335434 - DNA, 555 bp, Homo sapiens
gtggctgtctgaggggatgagagccctgcttagtggtggagagtccagaacattgacgccttccatgcagaagcattattcagcttttggctctgacatcctaagtgtcctatgttgtccaatttcagaagtaactgtatgatcattttatgaacctgaatttgaccagggctggtctttcatgggggccaagttggcagtcacctgcatggaaaatgatctgaagagcaactaaatcatctccctggatggttcacataagtctcagatctttcttttggggcactgcatatatctaaaggttcctttctgaaataaaaatgtctcacctggaagaagcaatatatgaacacattagtgcctattaatttgcgatagtttatcccataagcacctgcaggaatcaaatggtgaaatggtgtttgtgttcctattaccaagggattacatagtggtatcaaagctgattcctcaaggaaaacttctaggaagctgaatgtccaaattgttgaaagtttagaatcatgaatgctggatacttattcagtggatgag

SEQ ID NO: 335435 - DNA, 475 bp, Homo sapiens
cagtgaatgaagttggatccttgccttatgccacatataaaaataactcaaaatggataaaatagctgaatgtaagacctgaaaactataaaatttctggaaggaaacaggagaaaagcttaatgacattggatttgcaaaaatttatttgatatgacatgcaaaacacaggcagcaaagcaaaaatagacaaatgggactacatcaaacttaaaaactcctacacagcaaaggaaactgtcaagattgaaaaagcaacctatgaaatggaagaaaatatatgcaaaccatacatcagataaatggttaatatctagaatatataagaacttctacaacttaacaacaacaacacaaacaaattgcctgatttaaaaacatgggcaaaagacttgaatagatatttcttcaaagaagatatacaaatggccaagaagtatatgaaaagatgcttggtatcactaattatcaggaa

SEQ ID NO: 335436 - DNA, 544 bp, Homo sapiens
ggtaaatcacagtgcccacagctcctcacactggcagcacttcctcacccctgtgccattgcacctgctgttttctttttctagaataccccttggtctcctgccaagctcatccctattccttctgcaacacccagctcagaagtgacttccaggaagccttccaaatgtcccctcactggcaaaggtgagcctcttctaggctgccattagcattctctgtaacatttctccagctgcattttagctgcctgtttaccagtccactgttcctaagagactataaaccacttggaaaaggaattgtttattcatcttgaattcctagtgcctggtacagggtctgggacatagaaagtgcctgataaatgtttgttgaatgaatgatttaattaacaggataaaggagagaataatcaactgtgtcttttagcatttgggtcccctggtttttgtccatgctgctaggtttctgaagcacagccctccctaaaccttgcttgtgcctacatcagaacttctgaccttatcccttgttgatgag

SEQ ID NO: 335437 - DNA, 512 bp, Homo sapiens
gaggccaggttccctcacctcccctgttccaggctggaagtggcccagagggtaggaggctctttaaaaacagggatttggaccaggtgcagtggttcatgcctgtaatcccacactttgagaggatgaggtggggtggatcacctgaggtcaggagtttgagaccagcctggccaacatggtgaaaccctgtctctactaaaaatacaaaaattagccgggcgtggtggcacacacctgtaatcccagctacttgggaggctgaggcaggagaattgcttgaacccgggaggtggaggttacagtaagccaagatcacaccactgcactccagcctgagcaacagagcgagactccgtctcaaaaagtaaaataaaataacataaagtaaaataacagggatctgctatggcctcagatttaagggggaaacattcaccttattggcaacatagcctttgctttgagtaatcgtggcaacctgggaatagctttgtgaatttatgaagtgg

SEQ ID NO: 335438 - DNA, 417 bp, Homo sapiens
gaggccaggttccctcacctcccctgttccaggctggaagtggcccagagggtaggaggctctttaaaaacagggatttggaccaggtgcagtggttcatgcctgtaatcccacactttgagaggatgaggtggggtggatcacctgagcctcccaaagtgctgggattataggtgtgagccactgcgcctggcccaaggaaggtcatttgattaggacggggcagctgcatccattttgagcccagtccaagaggtgcctgggagcctctttggctctatgtgggccagcatcccatttgtacagggtgtgatggggagagaaacttgagaacttgaagagggtggctgaaggctcttcatggagctgatgacacttttcagaaccccagaagcaccaggctgaaactgccttgtc

SEQ ID NO: 335439 - DNA, 330 bp, Homo sapiens
gtttcgccatgttggccaggctggtctcgaactcctgacctcaggtgatccacccacctcagcctcccaaagtgctgggattataggtgtgagccactgcgcctggcccaaggaaggtcatttgattaggacggggcagctgcatccattttgagcccagtccaagaggtgcctgggagcctctttggctctatgtgggccagcatcccatttgtacagggtgtgatggggagagaaacttgagaacttgaagagggtggctgaaggctcttcatggagctgatgacacttttcagaaccccagaagcaccaggctgaaactgccttgtc

SEQ ID NO: 335440 - DNA, 326 bp, Homo sapiens
attcttctttgggaataatgtctggaatatgtcagtttcttcctattatcagtgttttcatttagcttcttagcctcacacctagactactgcttcctaattgactttcccacctccaggttcttctcactctaattcatctatgcagatacttccagatcagtattcccaaatcatcgttcttgttttatatttttttgagacagagtctcgctttgtcacccagggtggagtccagtggcgcgatctcagctcactgcaacctccgcctccctggctcaagcaattttcctgcctcagcctcccaggtagctgggattagaggc

SEQ ID NO: 335441 - DNA, 709 bp, Homo sapiens
gaccactctgtcatcttaactagcttggtaagcagatcctgggtttctgtattaaagctggtcctttgaatgaatgagagcactaatattttcagctggaggaaaacaacatgaataaaagtaaaaatggaagagtgtagggcctttttagggaaagtagacaatccactttggcaggagtgcagggtgtatacatggaaagatggggtgtgagttgagattggaaagatacgaaagtgttcacctgtagactaggttctaggagagtgtgttgtttttctattttcctattgttttccagataatatatttcttttgaagtcttttgaccataatcaagcctataatctatgaagaatgaattgccatatgtatgtagaaggtatcatttgagtcaaggagtgtgagaatgatatgtaagaggatgttcttatgtaatatgtaagagaagcaataaggacttaatgtgagacaaaagtgaatataatgaagatgaagttttggcatgacttaggaagtgtttgggtgaaacaacaacaaaaaaggaagcagaagggttaaagacaactgacattttgtgcctgagtaaatggaaaaatggtgtcgagttaacagattaggtaaagctaagaggttttcctagaactctggaaatttattaaatattttttcttaacgaaaagtgtaaactggcccataatgtaagcaa

SEQ ID NO: 335442 - DNA, 794 bp, Homo sapiens
gcctgagccaccgtgccccagtgagttggcattttaaacacaggttttagaactttcctggaggctgagtgaatatttttaaagattaagtgtctccttaagctttatcatgaataatatgcaacacttgggtttggctagaaatcactagggatttaatggtcctaaaaagggaaatactactctggcccataaatcaaggttaaacttctagggtccacacagagataaaatattagataggactgcaaatatgactgtcagaacgcctttcttatcttcatgaacaagttttttttctctctctgtacacagccatacattcatgtctgtaaatacctggcttttttaggctcagtttcacaaaatgttgcagaatgcttttaattctttctcattcttctcatcacaattaactgttgaacatagtttgcactagttttcaaatgtcaaccatgagagtttctatctcagggaaaaaaggagagattataaaagaattccactaatccgtaaatgagaaagggtatcttgatgtttattactgtttaattttccttccaacactaacagaggtacatatacagctactatgaataatggtgagtactctgtgaatactcttaggtactagtgcacatgatgttagttttacaaaacagttgagtcctatttctgttaaatttttatcccctagtataaaaacacaatttatgataaatcaggtaaaaatgaaaaatcaaagtcttagtttctttttttttttaattaagacaccatggaaaggtcaaact

SEQ ID NO: 335443 - DNA, 440 bp, Homo sapiens
tggtctgtatagaagatgaaaccagctacaacattctcttaagccaaagcctaatgcagagcaaggccctaactctcttcacgtctgtgaatgctaagagaggtgaggaagctgcagaagagtttgaggcttacagaggttggttataaagtttaaagaaggaagctgtctccaaaacataaaggtgacaggtgaagcagtaagtgctgatgtagaaattgcagcaagtgatccagaagatctagctaaggtaattgttgaaggtggctacactaaacaacagattttcagtgtagatgaaacaggtttctactggaagaagatgccatctcatagctaaagagaagtcaatgcttggctttcaaggacaggctgactcttgttgggggctgatagagctgatgattttaagttgaagctagttctcatttactgttctg

SEQ ID NO: 335444 - DNA, 334 bp, Homo sapiens
atgagctgcattaaactcgggcaagtcacttaactactctgtgcctcagtttctccactgggaaaaagggtattactagtacctaccggcatagggttattactaatgcagattaaataattatttgtaaaacacttagcacagtgccaggcagaggaggtgtcattaaatcagatggagtcgagtggtgggagagttactcccttcacttctcttaatccttatgtgtaatcagggagcaaggcagcctgctgaaccctggagctccacactcacccagcaggggctgtcgctcgcccacgcgcagctggtggtggaactgcttgctgatcat

SEQ ID NO: 335445 - DNA, 151 bp, Homo sapiens
aattatttgtccattgacgatcattttttatatggttctgatagccaccctttgaggtagatagtagttattttctactttcagaggaagctaaactgaagcccagaggagttaggggaagggaacacacccagtgttaccacaggcaatg

SEQ ID NO: 335446 - DNA, 326 bp, Homo sapiens
gatctagtgtgatataggggagaagcactgagccaagggaaaggaaacatgaaatctctggtatttgtaagctctgtgactttaggcaaattaagtaacctctctggtcctgagttctctcatctataatctgaagttaagcctcctcagcttggagactggatcagatggttttctggggctccatttccactctaagatgttcggcctcagtaattttctgcattcaagtatgttctcactttaaccagaggaatgcttaaactgatcctactggcagaaatcatgcttacaacactagatgaggaatcatgcagggcatgtgg

SEQ ID NO: 335447 - DNA, 405 bp, Homo sapiens
tctctccccttgaccgcagctggcttggctcggaacttggcacagagtggggcatcggatgcgtcagaattctttctcctcatgacagaccttccttcccttctccaccccatcactggcagcactcccatatcctcccacctgcaacactacttgcccttcacacacctgaatctgtctttgtttgttgagggttactaagaacactgggctgcgtgcatgttccctccttctccacttgacaatccattggcagtttcactttgagtcattcactgactgttctctccttgttggctgctgtggctttaggagccctgggttccctccctatacctctaacttgttttcttccggaagcctcttccacttgctccattcttctctgtattcttttttttttta

SEQ ID NO: 335448 - DNA, 393 bp, Homo sapiens
agctgttgggtcttgcctaacaccaatggggcccacaagtatatttctgttttgttttgggttttttccttgacaaaatgaagcatcccagacaatgaattaaaacagaaattttaaagagcttgggaagcaatagaaaagtcattttaaaaggccaaaaccaatatggatttaggtaataagagaatcccagggagactagaacagtcagtaaacactgtgcaagagcaaggcttagatgattacatattgaacctgattttgattaaatatcaaaatctttttttttgtatacgtgagatggggatgatcaggctttataataaaaatctccctctaaaacacatctgttatttaaaaagccaatgacacaacccctagataaagggagca

SEQ ID NO: 335449 - DNA, 333 bp, Homo sapiens
tgtaaatattcccaccatggcaattttcaagttaccaacgtgctgttgtcaaatgtggagttaggaagagatgcacagtagccaccactatgtagtttttctaccatataaatataacagaaacaaatgaagtgggaaagaattcaggaaacatttttaacctgttagtaaaagccaggtgtgatctggaagaactctagatctctgggagccacagatgtaaaaggagtttgtactcactcactggctgccttcttcggaccttcacaggtgctcatgagaaagaaaaggggcggggcaaagagggaagttgaggaaaccttcctgggagta

SEQ ID NO: 335450 - DNA, 697 bp, Homo sapiens
tagtatagagaaattctggtaagagtatttgttatcagatattttatcaatttgagtcaagtgttggaaactgagcagtttccaggtactttttaacttgagaatgccatctggtggtggtgccgagagaattatctggcttttactctagcctgtggccttacttttaattatgaaagttcctaagttgaaagtgcataatccagaggcactactgtaatgttactttttgtgttcttacctctccagggtaaaaaactgatttgtttttaaacacagaggcctcacattttttgtttaatgctaaaactcatatcttatgtcatgtttttaaagttgtaggtcatgacttgacacattagtggattacattagtggattctgaattcactctagtggttgaaacacctctaagtttatggctcaaagattcatatctttcatctgtgtttttcaaactatggattataatttgttaatgaattgtgaagtgagttgctgccaacatttaaaaaatagaatagaaattaacaagaaaatatcagtggttctcatggagcaaggttaattaaaacttttattttaattaactttttatttaattaaaacttttattttgtatatgtgtatgtaaatgtggtgggtcacaattgtgaatatttcttttttttttttttgagacggagtctcgctctgt

SEQ ID NO: 335451 - DNA, 928 bp, Homo sapiens
tctgtccccggaacccgtggttccttggcggctgggtctcttttcggcgcctctagaggcagagggaggggatccctgtcgtgacaagagcgcctgtctgcgacccaatggatctgcgaggcccttgcggggatctagtccctgggctctcaggagaagggggtgtctgcttgtgtgctggcgtttcttggagagatacggtggctgtcaccctcttctccaggcacacacagacacattcccactccctctgctcctcatgcccggttcctccggtgtgtcccaagacaggactagaaccgcgaaccgaagggcaaccagccaggtggtctccaggagctccgccccctctgggttcccaggactctgattggtcggcgagccagcccttccctcaccacgccccccgagagagtagttaagccttcagagcagttccaggagtccatttacgggaggggggagatgagcgctgctgaggcttgggggctcaggtcccgcaccattccccctccgcgacaatctgagagagctccagtggttacttttatctacctgtccgttcaccctaaactgtcactcgtcagtctcactctgagaagagacagtaacttgaaacgttgttctaaactcctaggcccgtcccccaaacacccttttgactgggacccccgcccctgcatgggacctcgcgcagaggggggtgtgtatgtgtgtgagtgtagaggaaggcttggcctaaggcctctccttctccctccccttgcctctggggtgggggtggggtgttgtggctgtgtgtgtggctgtggctccgtcccgggggttctgtcacccggctgtgtccagcctcctctccaccccccatacctaagagtcaccaacccggggtgtgattcaccacccgctggaaccgtgcaacctttcc

SEQ ID NO: 335452 - DNA, 445 bp, Homo sapiens
ggactctctgaggactggccttcctgagagtttatttgggagactaatatatcagactcctggtggtgtggcccctggacagtttctgccctaaaaccttctttgtgaacatcacattgactacaatgagagcagcgttcatccagctgtagcacctacacctgttgtgggatgctttactgatacaatctttgcaccactgtgaggtgggtgccatcatccctgtcttaaagatgaggaaactgaggctcagagaggttacttgaaccacaagtaaggaagtatgtgagtgagaatgggaacctcagtttctgactttttcctgttggtacatggcatgtggcttattctccaaaaagaaaaaggatcccgtcggtttcatttacttcttttttaagagagtaatttggaagaggctactggtgatcgttgggttgaatgttaa

SEQ ID NO: 335453 - DNA, 5663 bp, Homo sapiens
gccccgcccccgcacgcctatgggcgcgaggtgcgggccctgacgtcactcttgtcagggccgcggcacatgggcggccggatgcgctgagcccggcgctgcggggccgcggagcgctggggagcagcggccgccggcgcggggaggggggtggggtgggacggcgcaccgcctccggtgctggcactaggggctggggtcggcgcggtgtcttctgcccttctgcagccgtcgacatttttttttctttctttttttcaattttgaacattttgcaaaacgaggggttcgaggcaggtgagagcatcctgcacgtcgccggggagcccgcgggcacttggcgcgctctcctgggaccgtctgcactggaaacccgaaagttttttttttaatatatatttttatgcagatgtatttataaagatataagtaatttttttcttcccttttctccaccgccttgagagcgagtacttttggcaaaggacggaggaaaagctcagcaacattttagggggcggttgtttctttctttcttatttctttttttaaggggaaaaaatttgagtgcatcgcgatggagaaaatgtcccgaccgctccccctgaatcccacctttatcccgcctccctacggcgtgctcaggtccctgctggagaacccgctgaagctcccccttcaccacgaagacgcatttagtaaagataaagacaaggaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttataagttgctttcctcttactttcagttttggtgataatcgtcttcaaattaaagtgctgtttagatttattagatcccatatttacttactgctatctactaagtttccttttaattctaccaaccccagataagtaagagtactattaatagaacacagagtgtgtttttgcactgtctgtacctaaagcaataatcctattgtacgctagagcatgctgcctgagtattactagtggacgtaggatattttccctacctaagaatttcactgtcttttaaaaaacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaattctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttacgctagattaaaatatcctttcatcaatgggattttctagtttcctgccttcagagtatctaatcctttaatgatctggtggtctcctcgtcaatccatcagcaatgcttctctcatagtgtcatagacttgggaaacccaaccagtaggatatttctacaaggtgttcattttgtcacaagctgtagataacagcaagagatgggggtgtattggaattgcaatacattgttcaggtgaataataaaatcaaaaacttttgcaatcttaagcagagataaataaaagatagcaatatgagacacaggtggacgtagagttggcctttttacaggcaaagaggcgaattgtagaattgttagatggcaatagtcattaaaaacatagaaaaatgatgtctttaagtggagaattgtggaaggattgtaacatggaccatccaaatttatggccgtatcaaatggtagctgaaaaaactatatttgagcactggtctctcttggaattagatgtttatatcaaatgagcatctcaaatgttttctgcagaaaaaaataaaaagattctaataaaatgtattctcttgtgtgccaggagaggtttcagaaacctacctcgtcttacaaatttaaacactttggagtctgtacaggtgccttatatgtaggtcattgtcacgatacacacacacgaacactccctctggactggctgcctctccatccagggcagttaactagcaaacaaggcagatctgcttcatggagcgggaggccatggcttgactctgagtgatttgggtcaaccggagtcagacgcatgtctgcacgctgcagctattatgagagtccctttgtcatttttcaccttttcatcctaagcatctttcagagattaattatttggccattaacaatgaatccaaatcatatcatactgacatcatctagacatgatttggaaggaacagcttaggacctcctgatgaggtcacattgttgtttcttttaactagacttggcaaagaaaggcaaaaattgaccagcctatctttctgctggtgctgccttaaggaggtagtttgttgaggggagggctgtagatcattacttctttctcttcaggaagtggccactttgaaccattcaaataccacattaggcaagactgtgataggccttttgtcttcaaatacaacaggcctccactgacccatccctcaaagcagaaggaccctttgaggagagtacagatgggattccacagtggggtgggtggaatggaaacctgtactagaccacccagaggttccttctaacccactggtttggtggggaactcacagtaattccaaatgtacaatcagatgtctagggtctgttttcggaagaagcaagaattatcagtggcaccctccccactgcccccagtgtaaaacaatagacattctgtgaaatgcaaagctattctttggtttttctagtagtttatctcattttaccctattcttcctttaaggaaaactcaatctttatcacagtcaattagagcgatcccaaggcatgggaccaggcctgcttgcctatgtgtgatggcaattggagatctggatttagcactggggtctcagcaccctgcaggtgtctgagactaagtgatctgccctccaggtggcgatcaccttctgctcctaggtacccccactggcaaggccaaggtctcctccacgttttttctgcaattaataatgtcatttaaaaaatgagcaaagccttatccgaatcggatatagcaactaaagtcaatacattttgcaggaggctaagtgtaagagtgtgtgtgtgtgtgtgtgtgcgtgcatgtgtgtgtgtgtgtatgtgtgtgaataagtcgacataaagtctttaattttgagcaccttaccaaacataacaataatccattatccttttggcaacaccacaaagatcgcatctgttaaacaggtacaagttgacatgaggttagtttaattgtacaccatgatattggtggtatttatgctgttaagtccaaacctttatctgtctgttattcttaatgttgaataaactttgaattttttcctttcaaaaaaaaat

SEQ ID NO: 335454 - DNA, 5556 bp, Homo sapiens
gccccgcccccgcacgcctatgggcgcgaggtgcgggccctgacgtcactcttgtcagggccgcggcacatgggcggccggatgcgctgagcccggcgctgcggggccgcggagcgctggggagcagcggccgccggcgcggggaggggggtggggtgggacggcgcaccgcctccggtgctggcactaggggctggggtcggcgcggtgtcttctgcccttctgcagccgtcgacatttttttttctttctttttttcaattttgaacattttgcaaaacgaggggttcgaggcaggtgagagcatcctgcacgtcgccggggagcccgcgggcacttggcgcgctctcctgggaccgtctgcactggaaacccgaaagttttttttttaatatatatttttatgcagatgtatttataaagatataagtaatttttttcttcccttttctccaccgccttgagagcgagtacttttggcaaaggacggaggaaaagctcagcaacattttagggggcggttgtttctttctttcttatttctttttttaaggggaaaaaatttgagtgcatcgcgatggagaaaatgtcccgaccgctccccctgaatcccacctttatcccgcctccctacggcgtgctcaggtccctgctggagaacccgctgaagctcccccttcaccacgaagacgcatttagtaaagataaagacaaggaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttataagttgctttcctcttactttcagttttggtgataatcgtcttcaaattaaagtgctgtttagatttattagatcccatatttacttactgctatctactaagtttccttttaattctaccaaccccagataagtaagagtactattaatagaacacagagtgtgtttttgcactgtctgtacctaaagcaataatcctattgtacgctagagcatgctgcctgagtattactagtggacgtaggatattttccctacctaagaatttcactgtcttttaaaaaacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaattctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttacgctagattaaaatatcctttcatcaatgggattttctagtttcctgccttcagagtatctaatcctttaatgatctggtggtctcctcgtcaatccatcagcaatgcttctctcatagtgtcatagacttgggaaacccaaccagtaggatatttctacaaggtgttcattttgtcacaagctgtagataacagcaagagatgggggtgtattggaattgcaatacattgttcaggtgaataataaaatcaaaaacttttgcaatcttaagcagagataaataaaagatagcaatatgagacacaggtggacgtagagttggcctttttacaggcaaagaggcgaattgtagaattgttagatggcaatagtcattaaaaacatagaaaaatgatgtctttaagtggagaattgtggaaggattgtaacatggaccatccaaatttatggccgtatcaaatggtagctgaaaaaactatatttgagcactggtctctcttggaattagatgtttatatcaaatgagcatctcaaatgttttctgcagaaaaaaataaaaagattctaataaaatgtattctcttgtgtgccaggagaggtttcagaaacctacctcgtcttacaaatttaaacactttggagtctgtacaggtgccttatatgtaggtcattgtcacgatacacacacacgaacactccctctggactggctgcctctccatccagggcagttaactagcaaacaaggcagatctgcttcatggagcgggaggccatggcttgactctgagtgatttgggtcaaccggagtcagacgcatgtctgcacgctgcagctattatgagagtccctttgtcatttttcaccttttcatcctaagcatctttcagagattaattatttggccattaacaatgaatccaaatcatatcatactgacatcatctagacatgatttggaaggaacagcttaggacctcctgatgaggtcacattgttgtttcttttaactagacttggcaaagaaaggcaaaaattgaccagcctatctttctgctggtgctgccttaaggaggtagtttgttgaggggagggctgtagatcattacttctttctcttcaggaagtggccactttgaaccattcaaataccacattaggcaagactgtgataggccttttgtcttcaaatacaacaggcctccactaacccactggtttggtggggaactcacagtaattccaaatgtacaatcagatgtctagggtctgttttcggaagaagcaagaattatcagtggcaccctccccactgcccccagtgtaaaacaatagacattctgtgaaatgcaaagctattctttggtttttctagtagtttatctcattttaccctattcttcctttaaggaaaactcaatctttatcacagtcaattagagcgatcccaaggcatgggaccaggcctgcttgcctatgtgtgatggcaattggagatctggatttagcactggggtctcagcaccctgcaggtgtctgagactaagtgatctgccctccaggtggcgatcaccttctgctcctaggtacccccactggcaaggccaaggtctcctccacgttttttctgcaattaataatgtcatttaaaaaatgagcaaagccttatccgaatcggatatagcaactaaagtcaatacattttgcaggaggctaagtgtaagagtgtgtgtgtgtgtgtgtgtgcgtgcatgtgtgtgtgtgtgtatgtgtgtgaataagtcgacataaagtctttaattttgagcaccttaccaaacataacaataatccattatccttttggcaacaccacaaagatcgcatctgttaaacaggtacaagttgacatgaggttagtttaattgtacaccatgatattggtggtatttatgctgttaagtccaaacctttatctgtctgttattcttaatgttgaataaactttgaattttttcctttcaaaaaaaaat

SEQ ID NO: 335455 - DNA, 252 bp, Homo sapiens
ccaggtagacctaacccaggtagacctaacccaggtagacctaacccaggtagaccaaacataacaataatccattatccttttggcaacaccacaaagatcgcatctgttaaacaggtacaagttgacatgaggttagtttaattgtacaccatgatattggtggtatttatgctgttaagtccaaacctttatctgtctgttattcttaatgttgaataaactttgaattttttcctttcaaaaaaaaat

SEQ ID NO: 335456 - DNA, 848 bp, Homo sapiens
atttgtgtatttctgtgctttcttactttcttccttctactgattttcggttgttttggtttttcttttttatattcttgagatgtaacagtaacttatctatttgatatctttttggatgtaggtatttattgctataaacttccctcttggaactgctttttcttcattctttaaattctgatgtggttttatagtattcatctcataagacttaccttttacagttaaaatgttctaatttaagctgatagtaccttaattttattacctcatgaagactcttcatttgtttcatattttatatgttctgctgttgaagggaaaattctattatctggtaggtatatctagtctaaagtgttgttctaattcactaattcaatagaactgttggttctattgaaatgtcccattgttactaaatggaagttcgtagaatctttccaatctattacatcgttatatatataggtatgctgatgaagggagtgtgcatttttacaattggtacagaattttaattaactgaccctattatcataataatattcccccacgctctttacaggttttgactggaagcctttttttctgatatgagcatagcaacatctcctcttttgcttggaatagctttttaatcagcttttttaaaaaatagttttttaaacatttaattttaatgttgattccaagcaaatcaacatttgcttggaatagcttttttaatctctttactctcagtctctgtgtgttgttaagtctaatgtgagtgtctcgttagtggcgccatattgtttaatattttttgttcttttttttttaatctaacttgaatttctgtg

SEQ ID NO: 335457 - DNA, 394 bp, Homo sapiens
tctcatatacataatacagatattaccaacaaagtaggctatagtatagtcccattagaaaaaaatctttgtgttatatgttaagtacatgtataggcatgtgtgcacatgtatgtgcatgtatacatacacacaccataacactcctaaaagaggaatgagttaaatgacaatgaatacatattcattgggactacaaacaatatttgcacgtggaacagcaaatggctccattcttttaaatctagatgatgagctgggtgcggtggtacatgcttgtaatcccagcactttggaggggctgaggtgggccgaccgattgaggccaggagtttgagaccagtgatccatctgcctcggactcccaacgtgctggggattacaggcatgagcc

SEQ ID NO: 335458 - DNA, 195 bp, Homo sapiens
aacacataataatagctagaattggaggtagaggcagattacttataatgccagtcttttaaaatcctccttaattggcaagagtctgaagaagcttgtttggatttagaatttgtgaattcgtgtgaatgccatgaattctctaatatggagggggaaagagaaggaaattattgaacaactgctgtgtgcctg

SEQ ID NO: 335459 - DNA, 535 bp, Homo sapiens
caggaacaggctatgacctaatgcttgcttggaccagtgtaagcatgctagggcaaatacttaggctaaattgtgggagctaagaacataaggtacattgatttccttattaccgctagcagatatttaagaatgttaacacagttctttgaataaattttgcgtctaaggaataaatactatttattcctaattagatggggaggaaagtctttgaagaggaacctttactttactttttacaccgccatagctataattgagatcctcaggatcttctttccagactgcctccattcttcacctcttggaacccgtcgttttgacttgtcactagtgggctcaatctcaaaacacagagctaaccgtgcaacctctctgcttaatacctagggtggctcctagtcacccggccaagctgaacatagaacacaagatcttcattatctggcttctgcctattcctgggaccttacttcctgccattcttcaccttgcactttgagctctggtttcctgcatgtcatagctgttt

SEQ ID NO: 335460 - DNA, 477 bp, Homo sapiens
catattatgttcacagaacccgatttgagaaatactgatgcataggaaaaaatctgcatttaagcatgaacccattgcgctctccctccattgtttacttttttcagcattactttttattattctacaggaacttcctgctccctttaaatttattaatttcctcacaagcatatctgttcattttactgcctttgtgactgcttagataactttgcagtgttacaatagtggaaagccaaatggctttgggttcaactatgagctcccccacaatctgggagaaatatttagctctgtaagtcatgctttctttgaaaaaataaggctgaggtaagggatgataaacacctacccatagagggtagtaagagacactggtgaaggctcccagcacagtgtctggcacaaggaagacatcataaacaagtagtttttgaatcattctcaactctacctgtaccttaaagcccagca

SEQ ID NO: 335461 - DNA, 321 bp, Homo sapiens
gtggtaatcttgtgtatagaaaacaaggaatccactaaaaaactactaaaactaattaattttaggacatttctccttccccctcccctttgcatttaaattcaaaatggaatatttcttctgataataaatgtagtatatactttactggattataagtttccaagattcttgtctgttttgtagaaccctgtgtaagtaccacctgtacaaatgtctagtacatagaaggcactctttacatacttgaatgaatgcttattatagaaaaaaagtggaagatgtaaaaaaggtagaaaggaaaaaaaagagaaatgtgct

SEQ ID NO: 335462 - DNA, 288 bp, Homo sapiens
cctgatttatgtatcatttgcataccatgacattcagtgaacaggcacaagtctgtaaatccatatatgggaagctgctgggaccaaggattaaggaggggagaagcctgagtcactgaggggcatttgtgagatttaagagctagaaattaatgctataactgctcagaacagtgatagtagagaatatattgtgatcctaaggtgaaggaagtggcagtttgtcttgaacttctttctagtcagtgtactggccaagcatcgccacagagcatttcccaacctccc

SEQ ID NO: 335463 - DNA, 692 bp, Homo sapiens
aaggagggtgggaaggagggcaggggacaatggcatagtaacagtcttgctgttcctgagtccgggaaggaggattatgagtgcgacctgcatctggtaggcaacaaagaagcaaggatgggttttcagcagataaactgtcatacccatagactggactgagaaggtgggtgatggtgggcagcagagatgaagtggaggggacagagcaaaggcattgctgccctgtggtatctgccagaagtgcaaacccagaacttgatcacgatgaaatatccaaaaaactaaaacaaagccaaggccgggcacagtggctcacgcctgtaatgccagcactttgggaggtcgaggcttgtggatagcttgagctcaggagtttgagaccagcctgggaaacacagaaaccccatctctaccaaaaatacaaaaaattaaaaaaaaaaaaaaaagggaaaacaaagctaagctgaggaacaccctacaaaataactgattggtgattttatttttttggttttttggtttttgagatggagtctagctctgtcgccaggctggagtgcagtggcgtgatctcggctcattccaaccactgccttctgggttcaaacgattctcctgcctcagcttcccgagtagctgggactacaggtgcgtgccaccatgcccagctaattttttttttttttttt

SEQ ID NO: 335464 - DNA, 475 bp, Homo sapiens
ttccacagggctaggaaggaatcagggaacttataatcatggtggaaagggaaacaagcatgtccttcttcacgtggtggcaagaagaagaatgagagcagagcgaagggggaagccccttataaaaccatcagatctcatgagaacttactatcatgcgaatagcgtggaggaaatccctgattacctcccactgggtccctcccacaacatgtggagattatgggtactacaattcaatatgagattcgggtggggacatagccaaacaacatcaaccggaatcttgtattgcaagtttttattgaattttaaatcatgaagctaaacacttctttgataaacatctagaaggtgagaagtagctcaactctggagtaaggctaaactgggtctgaatatgttttatattctctggactttgaaatatgtctcttgataataaactagttagtctccctgtgaaaagtcaacc

SEQ ID NO: 335465 - DNA, 685 bp, Homo sapiens
agggaaggaatctgtgatgaattcagtgggagtccacacccataagtagaaatccaggctctagtattggtgtaagaagttaatatcatcttcttacattcttctttggttttcttttgcacacctacctttataatcttgttaataaattctagcagatcatgataaccaggacatggcaggaaataatgattaactaatctgtgtttatcctgtcaactgtactgtatctgggaacataagtcctcatggaaaaatttggcctttgtttatttaaatctgctcccacaaaggaaaggtaacgcatgagttttgccaaggctgcagggctttttattctttccctgccccacctcccccacccttccaatagaaatctaagggctgcaggtttattgctctttattctattcaatgcaaaatgagttgtccttgttgtccttcagccttgttttgccaagttttcatttggactaatagatggtgtatttcaaaaaatagtgctcaaaatgtaatatggcaccattagctttggactaccacagagagtttggagaatttcctggggcctatgtgttaatttaaagttgcaggaaagaacatgggaaggaacaacaatagctgtggttatactctatcctagagctgccaagcaggttaatattaatggtaatggcctcatgca

SEQ ID NO: 335466 - DNA, 303 bp, Homo sapiens
acaataccttgtaccataataaagtccaatttacctatacttgacactaattctcaacgaataaaaatgtaaacaattactgaggttgaagcttaacttggaagaaaagtttcctgtagaaatttgtaagattgcaaggagtaccagctgacataaagtttagccttgagagaatattaatgaagttagtttcctatctcattacaatgaaacttccaaatagtttctagcaggtaacattttgttagccttgatttcacatttgaaagaaaaatgtatgtttcaaattcgtaactcaatttt

SEQ ID NO: 335467 - DNA, 111 bp, Homo sapiens
tgttgacctcttctgcacacacacttttagaaaatgggctagaggactcatattttgcatgcatacacagaccacactcccctgcccctaccagccaaagcaggtggcaaa

SEQ ID NO: 335468 - DNA, 944 bp, Homo sapiens
tgcactccagtttgggtgacagagagagacctttctttaaaagtaataattacaatggaaatgaagtattgatttgaccatgggacaagtgggtggatgggtgtagggtttggcagtttaagaattaaaaacattggaggataatatctggactgaaaagatacagaaataaaacatgttgtgtagaaatgtggagataaagagcaggtggaaggcctgatagctgtggaagcacagtctctgcagagcaggctccacttgggtggaagctgtccttctcgtgtgagctctagccttgtactgtgtggcttctcaaactgtgtgcttggagtcacttgacaaaaattaaaattaagagaatggaaacttgccatcttgcataagtttttttgtcatttaatttgtcaacttttagtaggtctccttgtatggagactagtacactgttgatttagaaatacctgcaggttgatactagtttagtgcagtatcttgaagaaaccaagagcatagactttagagtcagttgtttacttgggtataaatgatgagctactgcatgctaggggctgttcccagataacagtggttaggaaaatacatgaggcctctccccttgacgaagtcacattctagtgatgggagatggacactgcagatgaatgagcaaggtcgtttcagattgcttgagagagataaaacctggaatgggttggaggagaaggccttccacggaatgcccctttgagcagagtcctgagggtgagaccaccacacttgcttgggaacagcaggggaaggcttcgagttctgggagttcattagaattcaggacagtcatcctcaacaagagaggacagttggccttgaggtgagacagaccctggcttgtgacatcaagggtggtgctggactggagggatgctggagtgtggcaggggctg

SEQ ID NO: 335469 - DNA, 133 bp, Homo sapiens
tcatttttctctttgaataccatcttccagttgcattttcctttgattacctcactactaattatctcattactgtacagtatctcaaagataatctggttaggtgatcacctgatacaaaagtaaataattc

SEQ ID NO: 335470 - DNA, 449 bp, Homo sapiens
gacacagggctgtggagtgacagtgaggagttgggcttttgtcctggggaacacaggaagcccatggagggttccctgccagggactgacatgatctgctttagatttagctgtgacatcctcagaacggggacattttcaccgagtcacgctgagaaggtctgagatgagtgaaaagatgtaacggaattcttacatggtggcctggaagggataaaggaaagggttggccttatcaaaactatccttgaaaattagagaagcctctttcacatacctgggataaaaaaacttcctttgcaagttctgatgccactgattcccaacatttaattcttcctcacaagaaaattacagtaacatttataaaatgcagatgtacaaagacacagctagttaccttcaaaacagggaggctgagtgcggtggctcactccttcacccaagca

SEQ ID NO: 335471 - DNA, 783 bp, Homo sapiens
agagagaaagggagagaaagagaaagaaacaacagagagaaagatgaagattatgtgcttactctcaggatcatccatgtccatacagaatgtcttttacactgtttataaacctcctcactataggccctgcaggccccttattcaactttttgattaaattggataaaaaaggaacagggcaaaaggaaacttcttgttattgtcttgtcacccttagtagcaggcacatacttaggaaagtcagatttcctgtgtatgagacatactagagtggaccaagggaagaaaaccctatgcagagcaacaagcgagtagcagtggacagggagcagtggggccctcggggaaaaaacagagctaatggccctggcagggttcctcacacccagagctctaccaccatgtgaagctaacactgcaagcccacacccatcatcacattgtatggggcagtttcttgaccctgtgtgagagcagagaagacacctataatggcaaaaacaaggcactcatgaagggattttagtgtcaggaaatgagatgaggtcaaggggatttgtatatagaaactgcagctgaatttgaaataaagtaaaccaccaaatgcttagtttgtgcttcattcaattgtaaagaactaaacatcgtttgtgagtaattcaaaccggaaagtgaagtgtaggatgtcatattggtgttggacgatacatatatatatttaaattctgtagcactgccaagtctgaattcaaatcagtaccctggaatggagctatcagt

SEQ ID NO: 335472 - DNA, 134 bp, Homo sapiens
ctcagtcctgggtgctttgtaaatgctcgagaaacaaagcctgttctgtttgtaagacgtagccagtattggaggagtggtggctccgtaagccccgggacctacccgtgaaaagggagaagagggtgatggga

SEQ ID NO: 335473 - DNA, 397 bp, Homo sapiens
ggaccgggagaccgactgagaggaagaaggtggttcagaagagctaaggcaaagtgtggggtttggggtttgcttgtttgtttgccaggggaaacaagtacacataccagagggaaatttagaaaggtaaagtttaggaagtcaaccacatgttatttacagactggaggctcaagttaccaaacaacagggtacggcaagactgcaccaaacttccttctccaagttacaaaggacaagctggaaatgtgtgcggaatgggaaacatgggctgattattgggacctacttatctagtcttcaaatctttttttttttttttttttgagacggagtctggctctgtcacccaggctggagtgcagtggcaccatcttggctcactgcaagctctgcc

SEQ ID NO: 335474 - DNA, 960 bp, Homo sapiens
ttctgagcttcgcgcgcggctgcagggattcgccgggactcgcgcgggggaccgcgcccggggatcctgcaggggcgggaagggggctcgggctccttgcttccgccgcagtggggcgctgccgggctccccggcactagcgctgctggcggccccggcggccgggcgtgctgcctgcaagatgtccgtgcgccgcggccggcggccggcgcggccggggacccgcctctcctggctgctgtgctgcagcgccctgctgtccccggccgcgggctacgtgatcgtgagctccgtgtcttgggccgtcaccaacgaggtggacgaggagctggacagcgcctccactgaggaggctatgcccgcgctgctagaggattcgggcagcatctggcagcaaagcttccccgcctctgcccacaaggaggacgcgcacctgcggccccgggcgggcgccgcccgggccaggccgccccccgcgccacccgggatgttctcctaccggcgcgagggcggccagacggccagtgcgcccccgggccctagactgcgcgccgccaccgcccgctccctggcccatgccagcgtctggggctgctggccaccgtgtccacccacaagaagatccaaggactgccatttgggaactgcctgcccgtcagtgatggccccttcaacaatagcactgggattcctttcttctacaatgacagccaaggaccccgtggtggctgatctgatgaagaaccccatggcctcgctgatgctgccagaatcagaaggggagttctgcagaacaaacatcgttgatccggaagatccccgatgtgtccagttaaccgctcactgggcagatgattcgcagtgtctccagacagaagtagaatttggcaagcagccatcgtttcaaggcaccagggtgaggaatggcctctcatattgatgggtcctcatgacatgagg

SEQ ID NO: 335475 - DNA, 830 bp, Homo sapiens
ttctgagcttcgcgcgcggctgcagggattcgccgggactcgcgcgggggaccgcgcccggggatcctgcaggggcgggaagggggctcgggctccttgcttccgccgcagtggggcgctgccgggctccccggcactagcgctgctggcggccccggcggccgggcgtgctgcctgcaagatgtccgtgcgccgcggccggcggccggcgcggccggggacccgcctctcctggctgctgtgctgcagcgccctgctgtccccggccgcgggctacgtgatcgtgagctccgtgtcttgggccgtcaccaacgaggtggacgaggagctggacagcgcctccactgaggaggctatgcccgcgctgctagaggattcgggcagcatctggcagcaaagcttccccgcctctgcccacaaggaggacgcgcacctgcggccccgggcgggcgccgcccgggccaggccgccccccgcgccacccgggatgttctcctaccggcgcgagggcggccagacggccagtgcgcccccgggccctagactgcgcgccgccaccgcccgctccctggcccatgccagcgtctggggctgctggccaccgtgtccacccacaagaagtccttggtgtttgcacttaaatgaaaaccttttcagtgatgcagccagacagctattgaccactgtctctttgttcgaagggttcatagcagccctgcattccctgcagcagcaatgacaccagggtgaacagggaaactctatgctagacttgagattacccgtggtcatttgccggatctccaactcagacagatacttcacgtaga

SEQ ID NO: 335476 - DNA, 949 bp, Homo sapiens
ttctgagcttcgcgcgcggctgcagggattcgccgggactcgcgcgggggaccgcgcccggggatcctgcaggggcgggaagggggctcgggctccttgcttccgccgcagtggggcgctgccgggctccccggcactagcgctgctggcggccccggcggccgggcgtgctgcctgcaagatgtccgtgcgccgcggccggcggccggcgcggccggggacccgcctctcctggctgctgtgctgcagcgccctgctgtccccggccgcgggctacgtgatcgtgagctccgtgtcttgggccgtcaccaacgaggtggacgaggagctggacagcgcctccactgaggaggctatgcccgcgctgctagaggattcgggcagcatctggcagcaaagcttccccgcctctgcccacaaggaggacgcgcacctgcggccccgggcgggcgccgcccgggccaggccgccccccgcgccacccgggatgttctcctaccggcgcgagggcggccagacggccagtgcgcccccgggccctagactgcgcgccgccaccgcccgctccctggcccatgccagcgtctggggctgctggccaccgtgtccacccacaagaagatccaaggactgccatttgggaactgcctgcccgtcagtgatggccccttcaacaatagcactgggattcctttcttctacaatgacagccaaggaccccgtggtggctgatctgatgaagaaccccatggcctcgctgatgctgccagaatcagaaggggagttctgcaggtagacgacggtttgccctcactcacacgggtcctgggaagtttttgacagagagttgggggtgggtttctctctgggtcacatgactttaacagaactctgagatgcacattgatgttcacccttgaaatcagataaattagaattccaccactca

SEQ ID NO: 335477 - DNA, 1170 bp, Homo sapiens
ttgtgcaacactggcaggagtccagacagctcctgttgttatggaaaagggcgagggtgggagtgagggttggtaaaggaagagccagtagttgatctccccagcacggaggcgtgcaacacagagtctatatattgtctttccaatttatttctatcctgtccccagagatatgtgcaataaggagccagcattttttaattcactttttcaaaagctctctgaaagaaaacacttctaaagacatttaagcactaacagaacattgatgcaggcccctttatctgaattcaaaatgcaaagcctgaactcgcatcctccccgggaaatgtctgcatggagctggtgtgggagctgcatgtgagatcccctcgtccttcccagaggagcagcaaatgcccaggatggcctggggtgagccctttaacctccaggaccttagtcactccacctaaatgtagtgatgctttagaaaatcaacaggcctcatcccatctgtgaaattctattattctttatgcacagcacggaaaacataataaccaaacaatgtattagttcttacagaggctaatcaaagcaactatacaatgcaagatgcatcctggataagccattgtttcccctcagccacgacagaccacatggagacacttcagctgaccctgttccccaccaggttacagcaagaagccaggaaaagaaacatttcctttctcatggaatattctccctgttcttggtcagtcaagcttactgttactagaagtacatttccaggatacctttcttttcttttcttactctttttttttttttttcgagatagagtttcgctcttgtttcccagactggagtgcagtggcgcaatctcggttcactgcaaccgtgaacctctgcctcccaggttcaagcaattctccctgcctcagcctcccaagtagctgggattacaggtgtccaccaccacgcctggctaatttttgtatttttagtagagacagggttttgccatgttgaccaggctggtctcaaactcctgacctcaggtgatccacctgcctcggccttccaatccaggatacctttctaagcttcccaggctttcctcattcaggtatcctgaaagcagtcgtgctggagcatgtggctcccagaacccagagcaca

SEQ ID NO: 335478 - DNA, 1794 bp, Homo sapiens
ttctgagcttcgcgcgcggctgcagggattcgccgggactcgcgcgggggaccgcgcccggggatcctgcaggggcgggaagggggctcgggctccttgcttccgccgcagtggggcgctgccgggctccccggcactagcgctgctggcggccccggcggccgggcgtgctgcctgcaagatgtccgtgcgccgcggccggcggccggcgcggccggggacccgcctctcctggctgctgtgctgcagcgccctgctgtccccggccgcgggctacgtgatcgtgagctccgtgtcttgggccgtcaccaacgaggtggacgaggagctggacagcgcctccactgaggaggctatgcccgcgctgctagaggattcgggcagcatctggcagcaaagcttccccgcctctgcccacaaggaggacgcgcacctgcggccccgggcgggcgccgcccgggccaggccgccccccgcgccacccgggatgttctcctaccggcgcgagggcggccagacggccagtgcgcccccgggccctagactgcgcgccgccaccgcccgctccctggcccatgccagcgtctggggctgctggccaccgtgtccacccacaagaagatccaaggactgccatttgggaactgcctgcccgtcagtgatggccccttcaacaatagcactgggattcctttcttctacaatgacagccaaggaccccgtggtggctgatctgatgaagaaccccatggcctcgctgatgctgccagaatcagaaggggagttctgcagagatatgtgcaataaggagccagcattttttaattcactttttcaaaagctctctgaaagaaaacacttctaaagacatttaagcactaacagaacattgatgcaggcccctttatctgaattcaaaatgcaaagcctgaactcgcatcctccccgggaaatgtctgcatggagctggtgtgggagctgcatgtgagatcccctcgtccttcccagaggagcagcaaatgcccaggatggcctggggtgagccctttaacctccaggaccttagtcactccacctaaatgtagtgatgctttagaaaatcaacaggcctcatcccatctgtgaaattctattattctttatgcacagcacggaaaacataataaccaaacaatgtattagttcttacagaggctaatcaaagcaactatacaatgcaagatgcatcctggataagccattgtttcccctcagccacgacagaccacatggagacacttcagctgaccctgttccccaccaggttacagcaagaagccaggaaaagaaacatttcctttctcatggaatattctccctgttcttggtcagtcaagcttactgttactagaagtacatttccaggatacctttcttttcttttcttactctttttttttttttttcgagatagagtttcgctcttgtttcccagactggagtgcagtggcgcaatctcggttcactgcaaccgtgaacctctgcctcccaggttcaagcaattctccctgcctcagcctcccaagtagctgggattacaggtgtccaccaccacgcctggctaatttttgtatttttagtagagacagggttttgccatgttgaccaggctggtctcaaactcctgacctcaggtgatccacctgcctcggccttccaatccaggatacctttctaagcttcccaggctttcctcattcaggtatcctgaaagcagtcgtgctggagcatgtggctcccagaacccagagcaca

SEQ ID NO: 335479 - DNA, 1404 bp, Homo sapiens
ttctgagcttcgcgcgcggctgcagggattcgccgggactcgcgcgggggaccgcgcccggggatcctgcaggggcgggaagggggctcgggctccttgcttccgccgcagtggggcgctgccgggctccccggcactagcgctgctggcggccccggcggccgggcgtgctgcctgcaagatgtccgtgcgccgcggccggcggccggcgcggccggggacccgcctctcctggctgctgtgctgcagcgccctgctgtccccggccgcgggctacgtgatcgtgagctccgtgtcttgggccgtcaccaacgaggtggacgaggagctggacagcgcctccactgaggaggctatgcccgcgctgctagaggattcgggcagcatctggcagcaaagcttccccgcctctgcccacaaggaggacgcgcacctgcggccccgggcgggcgccgcccgggccaggccgccccccgcgccacccgggatgttctcctaccggcgcgagggcggccagacggccagtgcgcccccgggccctagactgcgcgccgccaccgcccgctccctggcccatgccagcgtctggggctgctggccaccgtgtccacccacaagaagatccaaggactgccatttgggaactgcctgcccgtcagtgatggccccttcaacaatagcactgggattcctttcttctacaatgacagccaaggaccccgtggtggctgatctgatgaagaaccccatggcctcgctgatgctgccagaatcagaaggggagttctgcagttcttacagaggctaatcaaagcaactatacaatgcaagatgcatcctggataagccattgtttcccctcagccacgacagaccacatggagacacttcagctgaccctgttccccaccaggttacagcaagaagccaggaaaagaaacatttcctttctcatggaatattctccctgttcttggtcagtcaagcttactgttactagaagtacatttccaggatacctttcttttcttttcttactctttttttttttttttcgagatagagtttcgctcttgtttcccagactggagtgcagtggcgcaatctcggttcactgcaaccgtgaacctctgcctcccaggttcaagcaattctccctgcctcagcctcccaagtagctgggattacaggtgtccaccaccacgcctggctaatttttgtatttttagtagagacagggttttgccatgttgaccaggctggtctcaaactcctgacctcaggtgatccacctgcctcggccttccaatccaggatacctttctaagcttcccaggctttcctcattcaggtatcctgaaagcagtcgtgctggagcatgtggctcccagaacccagagcaca

SEQ ID NO: 335480 - DNA, 93 bp, Homo sapiens
cagaaccttccctgccacactggtgctccccactgagataggggtacatggagctcatctgttcccccaggagaccctcgggcaccacctctg

SEQ ID NO: 335481 - DNA, 2547 bp, Homo sapiens
agccgactccggagcccgagcccggggcgggtggacgcggactcgaacgcagttgcttcgggacccaggaccccctcgggcccgacccgccaggaaagactgaggccgcggcctgccccgcccggctccctgcgccgccgccgcctcccgggacagaagatgtgctccagggtccctctgctgctgccgctgctcctgctactggccctggggcctggggtgcagggctgcccatccggctgccagtgcagccagccacagacagtcttctgcactgcccgccaggggaccacggtgccccgagacgtgccacccgacacggtggggctgtacgtctttgagaacggcatcaccatgctcgacgcaggcagctttgccggcctgccgggcctgcagctcctggacctgtcacagaaccagatcgccagcctgcccagcggggtcttccagccactcgccaacctcagcaacctggacctgacggccaacaggctgcatgaaatcaccaatgagaccttccgtggcctgcggcgcctcgagcgcctctacctgggcaagaaccgcatccgccacatccagcctggtgccttcgacacgctcgaccgcctcctggagctcaagctgcaggacaacgagctgcgggcactgcccccgctgcgcctgccccgcctgctgctgctggacctcagccacaacagcctcctggccctggagcccggcatcctggacactgccaacgtggaggcgctgcggctggctggtctggggctgcagcagctggacgaggggctcttcagccgcttgcgcaacctccacgacctggatgtgtccgacaaccagctggagcgagtgccacctgtgatccgaggcctccggggcctgacgcgcctgcggctggccggcaacacccgcattgcccagctgcggcccgaggacctggccggcctggctgccctgcaggagctggatgtgagcaacctaagcctgcaggccctgcctggcgacctctcgggcctcttcccccgcctgcggctgctggcagctgcccgcaaccccttcaactgcgtgtgccccctgagctggtttggcccctgggtgcgcgagagccacgtcacactggccagccctgaggagacgcgctgccacttcccgcccaagaacgctggccggctgctcctggagcttgactacgccgactttggctgcccagccaccaccaccacagccacagtgcccaccacgaggcccgtggtgcgggagcccacagccttgtcttctagcttggctcctacctggcttagccccacagcgccggccactgaggcccccagcccgccctccactgccccaccgactgtagggcctgtcccccagccccaggactgcccaccgtccacctgcctcaatgggggcacatgccacctggggacacggcaccacctggcgtgcttgtgccccgaaggcttcacgggcctgtactgtgagagccagatggggcaggggacacggcccagccctacaccagtcacgccgaggccaccacggtccctgaccctgggcatcgagccggtgagccccacctccctgcgcgtggggctgcagcgctacctccaggggagctccgtgcagctcaggagcctccagtcacccctccacgcaaagccctacatctaagccagagagagacagggcagctggggccgggctctcagccagtgagatggccagccccctcctgctgccacaccacgtaagttctcagtcccaacctcggggatgtgtgcagacagggctgtgtgaccacagctgggccctgttccctctggacctcggtctcctcatctgtgagatgctgtggcccagctgacgagccctaacgtccccagaaccgagtgcctatgaggacagtgtccgccctgccctccgcaacgtgcagtccctgggcacggcgggccctgccatgtgctggtaacgcatgcctgggccctgctgggctctcccactccaggcggaccctgggggccagtgaaggaagctcccggaaagagcagagggagagcgggtaggcggctgtgtgactctagtcttggccccaggaagcgaaggaacaaaagaaactggaaaggaagatgctttaggaacatgttttgcttttttaaaatatatatatatttataagagatcctttcccatttattctgggaagatgtttttcaaactcagagacaaggactttggtttttgtaagacaaacgatgatatgaaggccttttgtaagaaaaaataaaagatgaagtgtgtttcttgggctcagccccagggtagaagggctgggtggagggagatgaagaaggagtggccctcgctctggggagccagggcccctcagcagcccctgggcttgggcagccctcccaggtgtcctgacctgggtgccatccaccctaggcttgaatgaggtgaggctgggcccaggtgggacaggccccgtggcgcgggtgttgatgtcagtgccgagtcaggcccagccacgcgaggctctggatt

SEQ ID NO: 335482 - DNA, 1839 bp, Homo sapiens
agccgactccggagcccgagcccggggcgggtggacgcggactcgaacgcagttgcttcgggacccaggaccccctcgggcccgacccgccaggaaagactgaggccgcggcctgccccgcccggctccctgcgccgccgccgcctcccgggacagaagatgtgctccagggtccctctgctgctgccgctgctcctgctactggccctggggcctggggtgcagggctgcccatccggctgccagtgcagccagccacagacagtcttctgcactgcccgccaggggaccacggtgccccgagacgtgccacccgacacggtggggctgtacgtctttgagaacggcatcaccatgctcgacgcaggcagctttgccggcctgccgggcctgcagctcctggacctgtcacagaaccagatcgccagcctgcccagcggggtcttccagccactcgccaacctcagcaacctggacctgacggccaacaggctgcatgaaatcaccaatgagaccttccgtggcctgcggcgcctcgagcgcctctacctgggcaagaaccgcatccgccacatccagcctggtgccttcgacacgctcgaccgcctcctggagctcaagctgcaggacaacgagctgcgggcactgcccccgctgcgcctgccccgcctgctgctgctggacctcagccacaacagcctcctggccctggagcccggcatcctggacactgccaacgtggaggcgctgcggctggctggtctggggctgcagcagctggacgaggggctcttcagccgcttgcgcaacctccacgacctggatgtgtccgacaaccagctggagcgagtgccacctgtgatccgaggcctccggggcctgacgcgcctgcggctggccggcaacacccgcattgcccagctgcggcccgaggacctggccggcctggctgccctgcaggagctggatgtgagcaacctaagcctgcaggccctgcctggcgacctctcgggcctcttcccccgcctgcggctgctggcagctgcccgcaaccccttcaactgcgtgtgccccctgagctggtttggcccctgggtgcgcgagagccacgtcacactggccagccctgaggagacgcgctgccacttcccgcccaagaacgctggccggctgctcctggagcttgactacgccgactttggctgcccagccaccaccaccacagccacagtgcccaccacgaggcccgtggtgcgggagcccacagccttgtcttctagcttggctcctacctggcttagccccacagcgccggccatgaaggaagctcccggaaagagcagagggagagcgggtaggcggctgtgtgactctagtcttggccccaggaagcgaaggaacaaaagaaactggaaaggaagatgctttaggaacatgttttgcttttttaaaatatatatatatttataagagatcctttcccatttattctgggaagatgtttttcaaactcagagacaaggactttggtttttgtaagacaaacgatgatatgaaggccttttgtaagaaaaaataaaagatgaagtgtgtttcttgggctcagccccagggtagaagggctgggtggagggagatgaagaaggagtggccctcgctctggggagccagggcccctcagcagcccctgggcttgggcagccctcccaggtgtcctgacctgggtgccatccaccctaggcttgaatgaggtgaggctgggcccaggtgggacaggccccgtggcgcgggtgttgatgtcagtgccgagtcaggcccagccacgcgaggctctggatt

SEQ ID NO: 335483 - DNA, 3054 bp, Homo sapiens
agccgactccggagcccgagcccggggcgggtggacgcggactcgaacgcagttgcttcgggacccaggaccccctcgggcccgacccgccaggaaagactgaggccgcggcctgccccgcccggctccctgcgccgccgccgcctcccgggacagaagatgtgctccagggtccctctgctgctgccgctgctcctgctactggccctggggcctggggtgcagggctgcccatccggctgccagtgcagccagccacagacagtcttctgcactgcccgccaggggaccacggtgccccgagacgtgccacccgacacggtggggctgtacgtctttgagaacggcatcaccatgctcgacgcaggcagctttgccggcctgccgggcctgcagctcctggacctgtcacagaaccagatcgccagcctgcccagcggggtcttccagccactcgccaacctcagcaacctggacctgacggccaacaggctgcatgaaatcaccaatgagaccttccgtggcctgcggcgcctcgagcgcctctacctgggcaagaaccgcatccgccacatccagcctggtgccttcgacacgctcgaccgcctcctggagctcaagctgcaggacaacgagctgcgggcactgcccccgctgcgcctgccccgcctgctgctgctggacctcagccacaacagcctcctggccctggagcccggcatcctggacactgccaacgtggaggcgctgcggctggctggtctggggctgcagcagctggacgaggggctcttcagccgcttgcgcaacctccacgacctggatgtgtccgacaaccagctggagcgagtgccacctgtgatccgaggcctccggggcctgacgcgcctgcggctggccggcaacacccgcattgcccagctgcggcccgaggacctggccggcctggctgccctgcaggagctggatgtgagcaacctaagcctgcaggccctgcctggcgacctctcgggcctcttcccccgcctgcggctgctggcagctgcccgcaaccccttcaactgcgtgtgccccctgagctggtttggcccctgggtgcgcgagagccacgtcacactggccagccctgaggagacgcgctgccacttcccgcccaagaacgctggccggctgctcctggagcttgactacgccgactttggctgcccagccaccaccaccacagccacagtgcccaccacgaggcccgtggtgcgggagcccacagccttgtcttctagcttggctcctacctggcttagccccacagcgccggccactgaggcccccagcccgccctccactgccccaccgactgtagggcctgtcccccagccccaggactgcccaccgtccacctgcctcaatgggggcacatgccacctggggacacggcaccacctggcgtgcttgtgccccgaaggcttcacgggcctgtactgtgagagccagatggggcaggggacacggcccagccctacaccagtcacgccgaggccaccacggtccctgaccctgggcatcgagccggtgagccccacctccctgcgcgtggggctgcagcgctacctccaggggagctccgtgcagctcaggagcctccgtctcacctatcgcaacctatcgggccctgataagcggctggtgacgctgcgactgcctgcctcgctcgctgagtacacggtcacccagctgcggcccaacgccacttactccgtctgtgtcatgcctttggggcccgggcgggtgccggagggcgaggaggcctgcggggaggcccatacacccccagccgtccactccaaccacgccccagtcacccaggcccgcgagggcaacctgccgctcctcattgcgcccgccctggccgcggtgctcctggccgcgctggctgcggtgggggcagcctactgtgtgcggcgggggcgggccatggcagcagcggctcaggacaaagggcaggtggggccaggggctgggcccctggaactggagggagtgaaggtccccttggagccaggcccgaaggcaacagagggcggtggagaggccctgcccagcgggtctgagtgtgaggtgccactcatgggcttcccagggcctggcctccagtcacccctccacgcaaagccctacatctaagccagagagagacagggcagctggggccgggctctcagccagtgagatggccagccccctcctgctgccacaccacgtaagttctcagtcccaacctcggggatgtgtgcagacagggctgtgtgaccacagctgggccctgttccctctggacctcggtctcctcatctgtgagatgctgtggcccagctgacgagccctaacgtccccagaaccgagtgcctatgaggacagtgtccgccctgccctccgcaacgtgcagtccctgggcacggcgggccctgccatgtgctggtaacgcatgcctgggccctgctgggctctcccactccaggcggaccctgggggccagtgaaggaagctcccggaaagagcagagggagagcgggtaggcggctgtgtgactctagtcttggccccaggaagcgaaggaacaaaagaaactggaaaggaagatgctttaggaacatgttttgcttttttaaaatatatatatatttataagagatcctttcccatttattctgggaagatgtttttcaaactcagagacaaggactttggtttttgtaagacaaacgatgatatgaaggccttttgtaagaaaaaataaaagatgaagtgtgtttcttgggctcagccccagggtagaagggctgggtggagggagatgaagaaggagtggccctcgctctggggagccagggcccctcagcagcccctgggcttgggcagccctcccaggtgtcctgacctgggtgccatccaccctaggcttgaatgaggtgaggctgggcccaggtgggacaggccccgtggcgcgggtgttgatgtcagtgccgagtcaggcccagccacgcgaggctctggatt

SEQ ID NO: 335484 - DNA, 3158 bp, Homo sapiens
agccgactccggagcccgagcccggggcgggtggacgcggactcgaacgcagttgcttcgggacccaggaccccctcgggcccgacccgccaggaaagactgaggccgcggcctgccccgcccggctccctgcgccgccgccgcctcccgggacagaagatgtgctccagggtccctctgctgctgccgctgctcctgctactggccctggggcctggggtgcagggctgcccatccggctgccagtgcagccagccacagacagtcttctgcactgcccgccaggggaccacggtgccccgagacgtgccacccgacacggtggggctgtacgtctttgagaacggcatcaccatgctcgacgcaggcagctttgccggcctgccgggcctgcagctcctggacctgtcacagaaccagatcgccagcctgcccagcggggtcttccagccactcgccaacctcagcaacctggacctgacggccaacaggctgcatgaaatcaccaatgagaccttccgtggcctgcggcgcctcgagcgcctctacctgggcaagaaccgcatccgccacatccagcctggtgccttcgacacgctcgaccgcctcctggagctcaagctgcaggacaacgagctgcgggcactgcccccgctgcgcctgccccgcctgctgctgctggacctcagccacaacagcctcctggccctggagcccggcatcctggacactgccaacgtggaggcgctgcggctggctggtctggggctgcagcagctggacgaggggctcttcagccgcttgcgcaacctccacgacctggatgtgtccgacaaccagctggagcgagtgccacctgtgatccgaggcctccggggcctgacgcgcctgcggctggccggcaacacccgcattgcccagctgcggcccgaggacctggccggcctggctgccctgcaggagctggatgtgagcaacctaagcctgcaggccctgcctggcgacctctcgggcctcttcccccgcctgcggctgctggcagctgcccgcaaccccttcaactgcgtgtgccccctgagctggtttggcccctgggtgcgcgagagccacgtcacactggccagccctgaggagacgcgctgccacttcccgcccaagaacgctggccggctgctcctggagcttgactacgccgactttggctgcccagccaccaccaccacagccacagtgcccaccacgaggcccgtggtgcgggagcccacagccttgtcttctagcttggctcctacctggcttagccccacagcgccggccactgaggcccccagcccgccctccactgccccaccgactgtagggcctgtcccccagccccaggactgcccaccgtccacctgcctcaatgggggcacatgccacctggggacacggcaccacctggcgtgcttgtgccccgaaggcttcacgggcctgtactgtgagagccagatggggcaggggacacggcccagccctacaccagtcacgccgaggccaccacggtccctgaccctgggcatcgagccggtgagccccacctccctgcgcgtggggctgcagcgctacctccaggggagctccgtgcagctcaggagcctccgtctcacctatcgcaacctatcgggccctgataagcggctggtgacgctgcgactgcctgcctcgctcgctgagtacacggtcacccagctgcggcccaacgccacttactccgtctgtgtcatgcctttggggcccgggcgggtgccggagggcgaggaggcctgcggggaggcccatacacccccagccgtccactccaaccacgccccagtcacccaggcccgcgagggcaacctgccgctcctcattgcgcccgccctggccgcggtgctcctggccgcgctggctgcggtgggggcagcctactgtgtgcggcgggggcgggccatggcagcagcggctcaggacaaagggcaggtggggccaggggctgggcccctggaactggagggagtgaaggtccccttggagccaggcccgaaggcaacagagggcggtggagaggccctgcccagcgggtctgagtgtgaggtgccactcatgggcttcccagggcctggcctccagtcacccctccacgcaaagccctacatctaagccagagagagacagggcagctggggccgggctctcagccagtgagatggccagccccctcctgctgccacaccacgtaagttctcagtcccaacctcggggatgtgtgcagacagggctgtgtgaccacagctgggccctgttccctctggacctcggtctcctcatctgtgagatgctgtggcccagctgacgagccctaacgtccccagaaccgagtgcctatgaggacagtgtccgccctgccctccgcaacgtgcagtccctgggcacggcgggccctgccatgtgctggtaacgcatgcctgggccctgctgggctctcccactccaggcggaccctgggggccagtgaaggaagctcccggaaagagcagagggagagcgggtaggcggctgtgtgactctagtcttggccccaggaagcgaaggaacaaaagaaactggaaaggaagatgctttaggaacatgttttgcttttttaaaatatatatatatttatagaaaaaaaaaaaaaaaaaaaaaaaaaaaaaaaaaaaaaaaaaaaaaaaaaaaaaaaagggggggggggggaaaaaatttcccccggggggggcgcaatttttcgggggtcccgggtttttttgttaaaggggggggcccaaataggggggggtattaaaacgagaggggcgggggcgcgcggctttggacagcagcgcgcgtgaccggggggcggacacacacgcggtgttccgcggggggccctctctgtgggggggagcggcgccccacatctctcgcgggtcgcgggccgcgccccattggctgcggcaccccacctccctccgcggaggttatttaggccggcccctgagggggcgacatatacaccatctggggcggcgcttttagttgtgtgtacccccggcggtatttattgctgcggccgtagagcaattctggcccacgcggtgttttgcggcacatttttgcga

SEQ ID NO: 335485 - DNA, 244 bp, Homo sapiens
ctgttcttgaatttaatcttttcggactgaattgattgccccattttgcagataagggagttgaggcctaggatttgttgatgtatcccattccctgctctacaagcaacaataataagggccaccatatgtaacacacttactatgtatgttcaccttttgctttcactatctgctttaatcttttaacagatctacgaggggagagatagtgactccattttacagatgaggaaactgaggc

SEQ ID NO: 335486 - DNA, 795 bp, Homo sapiens
atctaaaaatcactgtgctgaaggatactgtacatctaaaatgcaagcaatagtgatcacactaaggacagatcctgactttcaggctctagggtgcttgctcttgggccactcctttaagctgatcaggcctttgcacttctgcttatggggtttatcatgcaaggggacttggattaggctggcctctgtgcttaaccttgtagttattattttatgcaattactaccatagccttggcatgcccccattttgcagatgtggatatggaggccttgaaaagttaaaaaatacttgtaaaacatcacacagctaggaaggggcagagatggcctttcaagccattcctttcagattctaaaacttgtccctcgcaggcaccctggagtctgatccaaggatgtcattttcatgtacaggggaaagtgctttatgttagtgattgcaacagatgttctttagagttttttaaacttctgcagctgaaagtggagtatttcttaggtgactccctcagttttgctttaatgacttggaacccatcttaaaatgcaggaagaatgggccgggcactgtggctcacacctgtaatcccagcactttgggaggccgaggcgggcggatcatgaggtcaggagatccagaccatcctggctaacatgatgaaatcccgtctctactaaaagtacaaaatagccggggtggggggggccgagccaattaccggagggggcgaaaagggggaccccgggggggtgcgggccagaacggccgccaccgggggagaaaaccgcc

SEQ ID NO: 335487 - DNA, 328 bp, Homo sapiens
gcctgcaactatgtttgaggtccattcaagcctggagaggttttaaccagcccacaaaaatctcaccagcctttctgtgtcaccgagattgatgcgtccgatgcattggaccatcagttcctttaaaaattcagttagttaggctgacacttttgcatacctgtagctgagttctccgagatacaaggtcctttgaggatttccttggacactgcatatgacatcgctaaaaatcaaatgcaaactaatgtccacagcttaagggtaagtctatgtgtggtttctgttaccttcctatcttctattccccaagctggttttatccctg

SEQ ID NO: 335488 - DNA, 427 bp, Homo sapiens
actgaatcccatcacttcactatttgtcaactgagtgaccttagctaagttacaaaatgtctcagaggctgtttcctgacttccaaaatggggattaaatgaggtaatatatgcaaagcgcttagcacagggcctgacataataacaagcagcaagcaggggatatccttaaagctattcggatttgggagctgaaggagactttgttcattagttgtggctgaagaaaatgagactctcagagatgaagtgatgtgcccagttgggactagaaggcttggaccccactttgctgaccagggcaccttccacctcctcctccctcccagaagtccctacttcctatggaactgtcaggcacacaccagcaaccttggctttggaaagcaccagccaggcaccatgaccaatgaacctcttcccaggt

SEQ ID NO: 335489 - DNA, 412 bp, Homo sapiens
atttctcgtgcttcagcctccctagtagatgggactacaggcacgtgctacaacacccggctagtttttgcatttttaattgagatggggtttcaccatgatggccaggctggcgtcgaactccggacctcaagctgtctgcctgccctggcttcccaaagagtggggatcacaggcatgcaccaccatgcctagccttttgtttgtttgttttacaattcagtggatttaaaaaattgtggtaaaatatacacaacgtaagatttaccattgttaagtgtaaagttgagtgacgttaacttcattcatattgtcatgcaatcatcatcaccatccatcaccagagagtcttcatcttcccaaacagaaattctgcacccattaaacagtagctctccattccccagcccac

SEQ ID NO: 335490 - DNA, 296 bp, Homo sapiens
attaatacccactggggtcaccaccagaagaaaccagagaatgaaaacagcacctactaatgccaggaaggcagagcccaaataagaaaacactccatgtggagtgaaagctgcaggatgctctttttacctcccatctatgtgatttggtcagccttacaaccacacgtgcagtaagcagcagacaagatggtgcccggacaagtggaaagctcatttgcataatacaattatgaaagtaactctgagacttgtggttaccaagaagatagtcaatgtggggagaacggcaaagc

SEQ ID NO: 335491 - DNA, 310 bp, Homo sapiens
gtgtccatcaccaaactccttttgtaaccttctgaagaccttttgattggatcatttatgtgcattattggtggggagagaaaggagattttttgcaaaaagaagagattaactacgtgctagaaatccgcggactacctcaaaaaatccaaatgttctcagaatcaatgccttgacggatgtgccccaaactctgtcactttccaatatcaaaaattaagaagtattaagagcatatattaaacaataaagcgagtgcggcctagcgttttcttcttttcttttacataatataacgattaataaccaa

SEQ ID NO: 335492 - DNA, 3558 bp, Homo sapiens
ggaggcaggctgtggtcagtccacatttccggcactcgcaggttttggggcttgtagacggttgctcttggcaaaggcttcttcctccccagggctagagcctgaccattttccgggcgggcagctgccccgaccacaccaggaagggctgctcaggcggagccacctcgcaatccaggggtgacctgggggctccccgggacgcgaatgtcccgctcccccgccgccccgccccgtccggattctccctcgcctcttctggcgcggccgactgcgctgcgagtgaagaactccccgtttcctagatgccagctcctgagctcacgagcacgtccagagcggaggacactcgggacaccggggtccagctccggaaacggaaaattccacaagcccgtcactctaggaagcggcagcgaacgttctcggtaggtttaaccctcttcttcctctgaccgagcgagggctccccgtctgcggcgcggtcaggaccccgcactttcggcccggctcggggttctcggagtccgtcccaaggccgggccgcaccaccgctggggggcagcgaagcgagcctagaggagaaaaggcggtccccgccgagtgcacgccgggggcggggcacggcacgaaggctccgtggtcggacttctgggctgttcggaggccccggcccacctggagggccctggaagagtttccagcgcttcccgaggtaggcgtgagaagctcgacgcggaccacatctccctcgtcggccgcgtcgggagcttctagccccgcccccgcgtcgggccccgccccctccgctgtgtcgtcgtctagtcctacgccgccagtgcgcctgcgcaagacgctggacttggcgctcagcatcctagccgattgctgtacggaaggggcgtgccggaccgaagtgcgcagactcggaggcatactccctttggtgaccattcttcagtgcatgaagacagacagcatccagaaccgaacggcccgtgccctggggaacttagccatggaacctgagagctgtggggacatccactgtgctggtgctgttcccctgcttgtggagagcctgacagcctgccaggactcgcagtgcctacagagcgtggtgcgtgccctccgtaacctggcagactcaccccagcaccgcctggccttggcacagcagggagcagtgcgtccgctggccgagctcctggccactgccccagatgctgcactgaccttagccctcgtccgtgccctcctggaactcagccgaggctgctcccgggcctgtgctgagcagctaagtctgggtgggggattgggcccactcgtcagcctggcttcccaccccaagcgggcagtacgcgagggaaccattctgatcctcgccaacctgtgtgcccagggcctgattcggcctgcactgggcaatgctggtggcgtggaggtgctggtagatgagctccggcagcgccgggatcctaatggagctagcccaacctcccagcagcccctggtgcgggctgtgtgcctcctatgtcgtgaggccatcaaccgggcccgactgcgggatgctggtggcttggatctactgatgggcctgctgcgggaccctcgtgcaagcgcatggcaccctcgtattgtggctgcccttgtggggtttctgtatgacactggggccctgggccggctgcaggctctgggacttgtgcctctcctggctgggcagctgtgtggtgaggctggtgaggaggaagaagagggaagagaagctgcttcctgggactttcctgaggagaggacccctgagcgggcacagggtggaagcttccggagcctcaggtcgtggctgatctccgagggctatgccacaggccctgatgacatctcccccgactggtctcctgagcagtgtccgccggagcccatggagccggccagccccgccccgaccccgacctcgctgcgggcaccacgcacccaacgcactccgggccgcagccccgccgccgccatcgaggagccttggggacgcgaagggccagccctgctgctgctgtcgcgcttttcccaggcccctgacccaagtggggcacttgtgaccggcccggcgctgtacggcctgctgacctatgtgaccggcgcaccgggcccgcccagcccacgtgcactgcgcattctgtcacgcctcacctgcaaccctgcctgcctcgaggccttcgtgcgcagctatggcgcggcgctgctgcgggcctggctggtgctgggggtggcgcctgacgattggccggcaccacgtgcccggcccactctccacagccggcaccgagagctgggggagaggctactgcagaacctgacggttcaggctgagtcgccctttggggttggggccctgacgcacctgctgctctctgggagccctgaggaccgagtggcctgcgcgctgaccctgcccttcatctgccggaagccctctctgtggcgccggctgcttctggagcagggtggtctccggctcctccttgcggcgctgacccggccggccccacacccgctcttcctcttctttgccgcggactccctttcctgcctccaagacctggtgtctcccactgtgagcccagctgtcccacaggcagtccccatggacctagactcaccttccccttgcctctatgaacctctgctgggcccagcccctgtcccagctcccgacctgcacttcctgctggactcaggcctccagctccctgcccagcgagcggcctcagccaccgcctcccctttcttccgggccctgctgtcaggcagctttgcagaagcccagatggacctggtgcccctgcgaggtctgtcgcctggtgcagcctggcctgtcctgcatcatttgcatggttgtcgggggtgtggggctgccctggggcccgtgcccccaccaggccagcccctgctgggttcagaggccgaggaggcactggaggctgctggccgtttcctactgcctgggctggaggaggagctggaagaggccgtgggccgcatccacctgggaccccagggtggcccggagtcagtgggtgaggtgttccgcctgggccggccccggctggctgcccactgtgcccgctggacactggggtcagagcagtgcccgaggaagcggggtctggccctggtggggcttgtggaggcagcaggtgaagaggcagggcccctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaagccaaggccaggttctgggtgtagggcccagagaagcagaacagcccagagccccaggtgcctggcctggcctagacctctggaattgagattaaacaatttggagttggata

SEQ ID NO: 335493 - DNA, 4159 bp, Homo sapiens
ggaggcaggctgtggtcagtccacatttccggcactcgcaggttttggggcttgtagacggttgctcttggcaaaggcttcttcctccccagggctagagcctgaccattttccgggcgggcagctgccccgaccacaccaggaagggctgctcaggcggagccacctcgcaatccaggggtgacctgggggctccccgggacgcgaatgtcccgctcccccgccgccccgccccgtccggattctccctcgcctcttctggcgcggccgactgcgctgcgagtgaagaactccccgtttcctagatgccagctcctgagctcacgagcacgtccagagcggaggacactcgggacaccggggtccagctccggaaacggaaaattccacaagcccgtcactctaggaagcggcagcgaacgttctcggtaggtttaaccctcttcttcctctgaccgagcgagggctccccgtctgcggcgcggtcaggaccccgcactttcggcccggctcggggttctcggagtccgtcccaaggccgggccgcaccaccgctggggggcagcgaagcgagcctagaggagaaaaggcggtccccgccgagtgcacgccgggggcggggcacggcacgaaggctccgtggtcggacttctgggctgttcggaggccccggcccacctggagggccctggaagagtttccagcgcttcccgaggtaggcgtgagaagctcgacgcggaccacatctccctcatgcaccgcccgcacgtcccaggatgcgctgcgattaaggtactgccgcgcctcgtgtgcaaggacagacttccggggtcgagaactacaacttccgacttgcatcactgcggtggcgctaaacagcgtcagcgaggcggtgcccgacgatttccctgtcttccagttccgctccctgggatcagcggcgagaagcggggcgggagtctgaggcccgagccaagatggcggctgcgaagccaaccctcacggactcgctctcgttctgcctcgcgcagctcgcggcggcggccggggaggctctgggtggggaaaaggacccagcgaccaacgagacacccctgagccgcgcgctcctagccctccgcacgcgccacatcaaggcagcggggggaatcgagcgcttccgggcacgcggcgggctccgccccctactcgcgctgctacggcgagcggctgcagcgggttccgccccgtcccaggcaggccccggctccgccccctcgtcggccgcgtcgggagcttctagccccgcccccgcgtcgggccccgccccctccgctgtgtcgtcgtctagtcctacgccgccagtgcgcctgcgcaagacgctggacttggcgctcagcatcctagccgattgctgtacggaaggggcgtgccggaccgaagtgcgcagactcggaggcatactccctttggtgaccattcttcagtgcatgaagacagacagcatccagaaccgaacggcccgtgccctggggaacttagccatggaacctgagagctgtggggacatccactgtgctggtgctgttcccctgcttgtggagagcctgacagcctgccaggactcgcagtgcctacagagcgtggtgcgtgccctccgtaacctggcagactcaccccagcaccgcctggccttggcacagcagggagcagtgcgtccgctggccgagctcctggccactgccccagatgctgcactgaccttagccctcgtccgtgccctcctggaactcagccgaggctgctcccgggcctgtgctgagcagctaagtctgggtgggggattgggcccactcgtcagcctggcttcccaccccaagcgggcagtacgcgagggaaccattctgatcctcgccaacctgtgtgcccagggcctgattcggcctgcactgggcaatgctggtggcgtggaggtgctggtagatgagctccggcagcgccgggatcctaatggagctagcccaacctcccagcagcccctggtgcgggctgtgtgcctcctatgtcgtgaggccatcaaccgggcccgactgcgggatgctggtggcttggatctactgatgggcctgctgcgggaccctcgtgcaagcgcatggcaccctcgtattgtggctgcccttgtggggtttctgtatgacactggggccctgggccggctgcaggctctgggacttgtgcctctcctggctgggcagctgtgtggtgaggctggtgaggaggaagaagagggaagagaagctgcttcctgggactttcctgaggagaggacccctgagcgggcacagggtggaagcttccggagcctcaggtcgtggctgatctccgagggctatgccacaggccctgatgacatctcccccgactggtctcctgagcagtgtccgccggagcccatggagccggccagccccgccccgaccccgacctcgctgcgggcaccacgcacccaacgcactccgggccgcagccccgccgccgccatcgaggagccttggggacgcgaagggccagccctgctgctgctgtcgcgcttttcccaggcccctgacccaagtggggcacttgtgaccggcccggcgctgtacggcctgctgacctatgtgaccggcgcaccgggcccgcccagcccacgtgcactgcgcattctgtcacgcctcacctgcaaccctgcctgcctcgaggccttcgtgcgcagctatggcgcggcgctgctgcgggcctggctggtgctgggggtggcgcctgacgattggccggcaccacgtgcccggcccactctccacagccggcaccgagagctgggggagaggctactgcagaacctgacggttcaggctgagtcgccctttggggttggggccctgacgcacctgctgctctctgggagccctgaggaccgagtggcctgcgcgctgaccctgcccttcatctgccggtgagtgggaagtgggtgccttgcggggttgggggaggagtgctgtgtttcccaggcccgttgcccaccttttgaaaggccctctcttccctgtaggaagccctctctgtggcgccggctgcttctggagcagggtggtctccggctcctccttgcggcgctgacccggccggccccacacccgctcttcctcttctttgccgcggactccctttcctgcctccaagacctggtgtctcccactgtgagcccagctgtcccacaggcagtccccatggacctagactcaccttccccttgcctctatgaacctctgctgggcccagcccctgtcccagctcccgacctgcacttcctgctggactcaggcctccagctccctgcccagcgagcggcctcagccaccgcctcccctttcttccgggccctgctgtcaggcagctttgcagaagcccagatggacctggtgcccctgcgaggtctgtcgcctggtgcagcctggcctgtcctgcatcatttgcatggttgtcgggggtgtggggctgccctggggcccgtgcccccaccaggccagcccctgctgggttcagaggccgaggaggcactggaggctgctggccgtttcctactgcctgggctggaggaggagctggaagaggccgtgggccgcatccacctgggaccccagggtggcccggagtcagtgggtgaggtgttccgcctgggccggccccggctggctgcccactgtgcccgctggacactggggtcagagcagtgcccgaggaagcggggtctggccctggtggggcttgtggaggcagcaggtgaagaggcagggcccctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaagccaaggccaggttctgggtgtagggcccagagaagcagaacagcccagagccccaggtgcctggcctggcctagacctctggaattgagattaaacaatttggagttggata

SEQ ID NO: 335494 - DNA, 4081 bp, Homo sapiens
ggaggcaggctgtggtcagtccacatttccggcactcgcaggttttggggcttgtagacggttgctcttggcaaaggcttcttcctccccagggctagagcctgaccattttccgggcgggcagctgccccgaccacaccaggaagggctgctcaggcggagccacctcgcaatccaggggtgacctgggggctccccgggacgcgaatgtcccgctcccccgccgccccgccccgtccggattctccctcgcctcttctggcgcggccgactgcgctgcgagtgaagaactccccgtttcctagatgccagctcctgagctcacgagcacgtccagagcggaggacactcgggacaccggggtccagctccggaaacggaaaattccacaagcccgtcactctaggaagcggcagcgaacgttctcggtaggtttaaccctcttcttcctctgaccgagcgagggctccccgtctgcggcgcggtcaggaccccgcactttcggcccggctcggggttctcggagtccgtcccaaggccgggccgcaccaccgctggggggcagcgaagcgagcctagaggagaaaaggcggtccccgccgagtgcacgccgggggcggggcacggcacgaaggctccgtggtcggacttctgggctgttcggaggccccggcccacctggagggccctggaagagtttccagcgcttcccgaggtaggcgtgagaagctcgacgcggaccacatctccctcatgcaccgcccgcacgtcccaggatgcgctgcgattaaggtactgccgcgcctcgtgtgcaaggacagacttccggggtcgagaactacaacttccgacttgcatcactgcggtggcgctaaacagcgtcagcgaggcggtgcccgacgatttccctgtcttccagttccgctccctgggatcagcggcgagaagcggggcgggagtctgaggcccgagccaagatggcggctgcgaagccaaccctcacggactcgctctcgttctgcctcgcgcagctcgcggcggcggccggggaggctctgggtggggaaaaggacccagcgaccaacgagacacccctgagccgcgcgctcctagccctccgcacgcgccacatcaaggcagcggggggaatcgagcgcttccgggcacgcggcgggctccgccccctactcgcgctgctacggcgagcggctgcagcgggttccgccccgtcccaggcaggccccggctccgccccctcgtcggccgcgtcgggagcttctagccccgcccccgcgtcgggccccgccccctccgctgtgtcgtcgtctagtcctacgccgccagtgcgcctgcgcaagacgctggacttggcgctcagcatcctagccgattgctgtacggaaggggcgtgccggaccgaagtgcgcagactcggaggcatactccctttggtgaccattcttcagtgcatgaagacagacagcatccagaaccgaacggcccgtgccctggggaacttagccatggaacctgagagctgtggggacatccactgtgctggtgctgttcccctgcttgtggagagcctgacagcctgccaggactcgcagtgcctacagagcgtggtgcgtgccctccgtaacctggcagactcaccccagcaccgcctggccttggcacagcagggagcagtgcgtccgctggccgagctcctggccactgccccagatgctgcactgaccttagccctcgtccgtgccctcctggaactcagccgaggctgctcccgggcctgtgctgagcagctaagtctgggtgggggattgggcccactcgtcagcctggcttcccaccccaagcgggcagtacgcgagggaaccattctgatcctcgccaacctgtgtgcccagggcctgattcggcctgcactgggcaatgctggtggcgtggaggtgctggtagatgagctccggcagcgccgggatcctaatggagctagcccaacctcccagcagcccctggtgcgggctgtgtgcctcctatgtcgtgaggccatcaaccgggcccgactgcgggatgctggtggcttggatctactgatgggcctgctgcgggaccctcgtgcaagcgcatggcaccctcgtattgtggctgcccttgtggggtttctgtatgacactggggccctgggccggctgcaggctctgggacttgtgcctctcctggctgggcagctgtgtggtgaggctggtgaggaggaagaagagggaagagaagctgcttcctgggactttcctgaggagaggacccctgagcgggcacagggtggaagcttccggagcctcaggtcgtggctgatctccgagggctatgccacaggccctgatgacatctcccccgactggtctcctgagcagtgtccgccggagcccatggagccggccagccccgccccgaccccgacctcgctgcgggcaccacgcacccaacgcactccgggccgcagccccgccgccgccatcgaggagccttggggacgcgaagggccagccctgctgctgctgtcgcgcttttcccaggcccctgacccaagtggggcacttgtgaccggcccggcgctgtacggcctgctgacctatgtgaccggcgcaccgggcccgcccagcccacgtgcactgcgcattctgtcacgcctcacctgcaaccctgcctgcctcgaggccttcgtgcgcagctatggcgcggcgctgctgcgggcctggctggtgctgggggtggcgcctgacgattggccggcaccacgtgcccggcccactctccacagccggcaccgagagctgggggagaggctactgcagaacctgacggttcaggctgagtcgccctttggggttggggccctgacgcacctgctgctctctgggagccctgaggaccgagtggcctgcgcgctgaccctgcccttcatctgccggccctctcttccctgtaggaagccctctctgtggcgccggctgcttctggagcagggtggtctccggctcctccttgcggcgctgacccggccggccccacacccgctcttcctcttctttgccgcggactccctttcctgcctccaagacctggtgtctcccactgtgagcccagctgtcccacaggcagtccccatggacctagactcaccttccccttgcctctatgaacctctgctgggcccagcccctgtcccagctcccgacctgcacttcctgctggactcaggcctccagctccctgcccagcgagcggcctcagccaccgcctcccctttcttccgggccctgctgtcaggcagctttgcagaagcccagatggacctggtgcccctgcgaggtctgtcgcctggtgcagcctggcctgtcctgcatcatttgcatggttgtcgggggtgtggggctgccctggggcccgtgcccccaccaggccagcccctgctgggttcagaggccgaggaggcactggaggctgctggccgtttcctactgcctgggctggaggaggagctggaagaggccgtgggccgcatccacctgggaccccagggtggcccggagtcagtgggtgaggtgttccgcctgggccggccccggctggctgcccactgtgcccgctggacactggggtcagagcagtgcccgaggaagcggggtctggccctggtggggcttgtggaggcagcaggtgaagaggcagggcccctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaagccaaggccaggttctgggtgtagggcccagagaagcagaacagcccagagccccaggtgcctggcctggcctagacctctggaattgagattaaacaatttggagttggata

SEQ ID NO: 335495 - DNA, 5121 bp, Homo sapiens
ggaggcaggctgtggtcagtccacatttccggcactcgcaggttttggggcttgtagacggttgctcttggcaaaggcttcttcctccccagggctagagcctgaccattttccgggcgggcagctgccccgaccacaccaggaagggctgctcaggcggagccacctcgcaatccaggggtgacctgggggctccccgggacgcgaatgtcccgctcccccgccgccccgccccgtccggattctccctcgcctcttctggcgcggccgactgcgctgcgagtgaagaactccccgtttcctagatgccagctcctgagctcacgagcacgtccagagcggaggacactcgggacaccggggtccagctccggaaacggaaaattccacaagcccgtcactctaggaagcggcagcgaacgttctcggtaggtttaaccctcttcttcctctgaccgagcgagggctccccgtctgcggcgcggtcaggaccccgcactttcggcccggctcggggttctcggagtccgtcccaaggccgggccgcaccaccgctggggggcagcgaagcgagcctagaggagaaaaggcggtccccgccgagtgcacgccgggggcggggcacggcacgaaggctccgtggtcggacttctgggctgttcggaggccccggcccacctggagggccctggaagagtttccagcgcttcccgaggtaggcgtgagaagctcgacgcggaccacatctccctcatgcaccgcccgcacgtcccaggatgcgctgcgattaaggtactgccgcgcctcgtgtgcaaggacagacttccggggtcgagaactacaacttccgacttgcatcactgcggtggcgctaaacagcgtcagcgaggcggtgcccgacgatttccctgtcttccagttccgctccctgggatcagcggcgagaagcggggcgggagtctgaggcccgagccaagatggcggctgcgaagccaaccctcacggactcgctctcgttctgcctcgcgcagctcgcggcggcggccggggaggctctgggtggggaaaaggacccagcgaccaacgagacacccctgagccgcgcgctcctagccctccgcacgcgccacatcaaggcagcggggggaatcgagcgcttccgggcacgcggcgggctccgccccctactcgcgctgctacggcgagcggctgcagcgggttccgccccgtcccaggcaggccccggctccgccccctcgtcggccgcgtcgggagcttctagccccgcccccgcgtcgggccccgccccctccgctgtgtcgtcgtctagtcctacgccgccagtgcgcctgcgcaagacgctggacttggcgctcagcatcctagccgattgctgtacggaaggggcgtgccggaccgaagtgcgcagactcggaggcatactccctttggtgaccattcttcagtgcatgaagacagacagcatccagaaccgaacggcccgtgccctggggaacttagccatggaacctgagagctgtggggacatccactgtgctggtgctgttcccctgcttgtggagagcctgacagcctgccaggactcgcagtgcctacagagcgtggtgcgtgccctccgtaacctggcagactcaccccagcaccgcctggccttggcacagcagggagcagtgcgtccgctggccgagctcctggccactgccccagatgctgcactgaccttagccctcgtccgtgccctcctggaactcagccgaggctgctcccgggcctgtgctgagcagctaagtctgggtgggggattgggcccactcgtcagcctggcttcccaccccaagcgggcagtacgcgagggaaccattctgatcctcgccaacctgtgtgcccagggcctgattcggcctgcactgggcaatgctggtggcgtggaggtgctggtagatgagctccggcagcgccgggatcctaatggagctagcccaacctcccagcagcccctggtgcgggctgtgtgcctcctatgtcgtgaggccatcaaccgggcccgactgcgggatgctggtggcttggatctactgatgggcctgctgcgggaccctcgtgcaagcgcatggcaccctcgtattgtggctgcccttgtggggtttctgtatgacactggggccctgggccggctgcaggctctgggacttgtgcctctcctggctgggcagctgtgtggtgaggctggtgaggaggaagaagagggaagagaagctgcttcctgggactttcctgaggagaggacccctgagcgggcacagggtggaagcttccggagcctcaggtcgtggctgatctccgagggctatgccacaggccctgatgacatctcccccgactggtctcctgagcagtgtccgccggagcccatggagccggccagccccgccccgaccccgacctcgctgcgggcaccacgcacccaacgcactccgggccgcagccccgccgccgccatcgaggagccttggggacgcgaagggccagccctgctgctgctgtcgcgcttttcccaggcccctgacccaagtggggcacttgtgaccggcccggcgctgtacggcctgctgacctatgtgaccggcgcaccgggcccgcccagcccacgtgcactgcgcattctgtcacgcctcacctgcaaccctgcctgcctcgaggccttcgtgcgcagctatggcgcggcgctgctgcgggcctggctggtgctgggggtggcgcctgacgattggccggcaccacgtgcccggcccactctccacagccggcaccgagagctgggtgagttcccatacccacccgtctccttgcccccatgtgagtccccatcctcccccatggcttccatgggcccagaacctcaccttcccactcacctgtcctccccagcccgtcctccagacaacctgtcaccagagtggggtggggagcagggcgttccagtccctccatgggcccacaggcagagttctgctgtgtcctctgccctagccctgggacccagataccctaactctagatgcagccccgcgcccaggatctgggctggtctgtgcttctttcctggctctgccattggttcagcactgtcctgactgctccccaccagcacgctgacctgtgaaccccagcctcaccatcacccccagcactgccagggactgccctgtctgctgtgccctgaccacaggctgcttcatggcgttactgctagaccaaggagcccttctgctggccctgtccgggcataacagaaggctcgcactcttgtcttctggtcacacctcactatgtcccctcagctcctatctctgtatggcctggtttttcccaggttatgattatagagcgaggattattacaatattgggataaagagtaattactacaaactaatgattaatgatattcatatatctctaagatctatatctggtataactattcttgttttatattgtattatactggaacagctcgtgtcctccgtctcttgcctcggcgcctgggtggcttgccgcccacacttcaggggcccagacttacaccctgactgtcccaccttctgtccttgtcctggacctcaggttcccagcgtcccgagcccagcactgtctcttcagtgccctgatttctcacccagaggtttcaccctccttcatctcacgggcccagagccctgtctcactcaccccacctgtcttagaccccagttcccagcctgacaagctttccactcacaggggagaggctactgcagaacctgacggttcaggctgagtcgccctttggggttggggccctgacgcacctgctgctctctgggagccctgaggaccgagtggcctgcgcgctgaccctgcccttcatctgccggtgagtgggaagtgggtgccttgcggggttgggggaggagtgctgtgtttcccaggcccgttgcccaccttttgaaaggccctctcttccctgtaggaagccctctctgtggcgccggctgcttctggagcagggtggtctccggctcctccttgcggcgctgacccggccggccccacacccgctcttcctcttctttgccgcggactccctttcctgcctccaagacctggtgtctcccactgtgagcccagctgtcccacaggcagtccccatggacctagactcaccttccccttgcctctatgaacctctgctgggcccagcccctgtcccagctcccgacctgcacttcctgctggactcaggcctccagctccctgcccagcgagcggcctcagccaccgcctcccctttcttccgggccctgctgtcaggcagctttgcagaagcccagatggacctggtgcccctgcgaggtctgtcgcctggtgcagcctggcctgtcctgcatcatttgcatggttgtcgggggtgtggggctgccctggggcccgtgcccccaccaggccagcccctgctgggttcagaggccgaggaggcactggaggctgctggccgtttcctactgcctgggctggaggaggagctggaagaggccgtgggccgcatccacctgggaccccagggtggcccggagtcagtgggtgaggtgttccgcctgggccggccccggctggctgcccactgtgcccgctggacactggggtcagagcagtgcccgaggaagcggggtctggccctggtggggcttgtggaggcagcaggtgaagaggcagggcccctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaagccaaggccaggttctgggtgtagggcccagagaagcagaacagcccagagccccaggtgcctggcctggcctagacctctggaattgagattaaacaatttggagttggata

SEQ ID NO: 335496 - DNA, 5025 bp, Homo sapiens
ggaggcaggctgtggtcagtccacatttccggcactcgcaggttttggggcttgtagacggttgctcttggcaaaggcttcttcctccccagggctagagcctgaccattttccgggcgggcagctgccccgaccacaccaggaagggctgctcaggcggagccacctcgcaatccaggggtgacctgggggctccccgggacgcgaatgtcccgctcccccgccgccccgccccgtccggattctccctcgcctcttctggcgcggccgactgcgctgcgagtgaagaactccccgtttcctagatgccagctcctgagctcacgagcacgtccagagcggaggacactcgggacaccggggtccagctccggaaacggaaaattccacaagcccgtcactctaggaagcggcagcgaacgttctcggtaggtttaaccctcttcttcctctgaccgagcgagggctccccgtctgcggcgcggtcaggaccccgcactttcggcccggctcggggttctcggagtccgtcccaaggccgggccgcaccaccgctggggggcagcgaagcgagcctagaggagaaaaggcggtccccgccgagtgcacgccgggggcggggcacggcacgaaggctccgtggtcggacttctgggctgttcggaggccccggcccacctggagggccctggaagagtttccagcgcttcccgaggtaggcgtgagaagctcgacgcggaccacatctccctcatgcaccgcccgcacgtcccaggatgcgctgcgattaaggtactgccgcgcctcgtgtgcaaggacagacttccggggtcgagaactacaacttccgacttgcatcactgcggtggcgctaaacagcgtcagcgaggcggtgcccgacgatttccctgtcttccagttccgctccctgggatcagcggcgagaagcggggcgggagtctgaggcccgagccaagatggcggctgcgaagccaaccctcacggactcgctctcgttctgcctcgcgcagctcgcggcggcggccggggaggctctgggtggggaaaaggacccagcgaccaacgagacacccctgagccgcgcgctcctagccctccgcacgcgccacatcaaggcagcggggggaatcgagcgcttccgggcacgcggcgggctccgccccctactcgcgctgctacggcgagcggctgcagcgggttccgccccgtcccaggcaggccccggctccgccccctcgtcggccgcgtcgggagcttctagccccgcccccgcgtcgggccccgccccctccgctgtgtcgtcgtctagtcctacgccgccagtgcgcctgcgcaagacgctggacttggcgctcagcatcctagccgattgctgtacggaaggggcgtgccggaccgaagtgcgcagactcggaggcatactccctttggtgaccattcttcagtgcatgaagacagacagcatccagaaccgaacggcccgtgccctggggaacttagccatggaacctgagagctgtggggacatccactgtgctggtgctgttcccctgcttgtggagagcctgacagcctgccaggactcgcagtgcctacagagcgtggtgcgtgccctccgtaacctggcagactcaccccagcaccgcctggccttggcacagcagggagcagtgcgtccgctggccgagctcctggccactgccccagatgctgcactgaccttagccctcgtccgtgccctcctggaactcagccgaggctgctcccgggcctgtgctgagcagctaagtctgggtgggggattgggcccactcgtcagcctggcttcccaccccaagcgggcagtacgcgagggaaccattctgatcctcgccaacctgtgtgcccagggcctgattcggcctgcactgggcaatgctggtggcgtggaggtgctggtagatgagctccggcagcgccgggatcctaatggagctagcccaacctcccagcagcccctggtgcgggctgtgtgcctcctatgtcgtgaggccatcaaccgggcccgactgcgggatgctggtggcttggatctactgatgggcctgctgcgggaccctcgtgcaagcgcatggcaccctcgtattgtggctgcccttgtggggtttctgtatgacactggggccctgggccggctgcaggctctgggacttgtgcctctcctggctgggcagctgtgtggtgaggctggtgaggaggaagaagagggaagagaagctgcttcctgggactttcctgaggagaggacccctgagcgggcacagggtggaagcttccggagcctcaggtcgtggctgatctccgagggctatgccacaggccctgatgacatctcccccgactggtctcctgagcagtgtccgccggagcccatggagccggccagccccgccccgaccccgacctcgctgcgggcaccacgcacccaacgcactccgggccgcagccccgccgccgccatcgaggagccttggggacgcgaagggccagccctgctgctgctgtcgcgcttttcccaggcccctgacccaagtggggcacttgtgaccggcccggcgctgtacggcctgctgacctatgtgaccggcgcaccgggcccgcccagcccacgtgcactgcgcattctgtcacgcctcacctgcaaccctgcctgcctcgaggccttcgtgcgcagctatggcgcggcgctgctgcgggcctggctggtgctgggggtggcgcctgacgattggccggcaccacgtgcccggcccactctccacagccggcaccgagagctgggtgagttcccatacccacccgtctccttgcccccatgtgagtccccatcctcccccatggcttccatgggcccagaacctcaccttcccactcacctgtcctccccagcccgtcctccagacaacctgtcaccagagtggggtggggagcagggcgttccagtccctccatgggcccacaggcagagttctgctgtgtcctctgccctagccctgggacccagataccctaactctagatgcagccccgcgcccaggatctgggctggtctgtgcttctttcctggctctgccattggttcagcactgtcctgactgctccccaccagcacgctgacctgtgaaccccagcctcaccatcacccccagcactgccagggactgccctgtctgctgtgccctgaccacaggctgcttcatggcgttactgctagaccaaggagcccttctgctggccctgtccgggcataacagaaggctcgcactcttgtcttctggtcacacctcactatgtcccctcagctcctatctctgtatggcctggtttttcccaggttatgattatagagcgaggattattacaatattgggataaagagtaattactacaaactaatgattaatgatattcatatatctctaagatctatatctggtataactattcttgttttatattgtattatactggaacagctcgtgtcctccgtctcttgcctcggcgcctgggtggcttgccgcccacacttcaggggcccagacttacaccctgactgtcccaccttctgtccttgtcctggacctcaggttcccagcgtcccgagcccagcactgtctcttcagtgccctgatttctcacccagaggtttcaccctccttcatctcacgggcccagagccctgtctcactcaccccacctgtcttagaccccagttcccagcctgacaagctttccactcacaggggagaggctactgcagaacctgacggttcaggctgagtcgccctttggggttggggccctgacgcacctgctgctctctgggagccctgaggaccgagtggcctgcgcgctgaccctgcccttcatctgccggaagccctctctgtggcgccggctgcttctggagcagggtggtctccggctcctccttgcggcgctgacccggccggccccacacccgctcttcctcttctttgccgcggactccctttcctgcctccaagacctggtgtctcccactgtgagcccagctgtcccacaggcagtccccatggacctagactcaccttccccttgcctctatgaacctctgctgggcccagcccctgtcccagctcccgacctgcacttcctgctggactcaggcctccagctccctgcccagcgagcggcctcagccaccgcctcccctttcttccgggccctgctgtcaggcagctttgcagaagcccagatggacctggtgcccctgcgaggtctgtcgcctggtgcagcctggcctgtcctgcatcatttgcatggttgtcgggggtgtggggctgccctggggcccgtgcccccaccaggccagcccctgctgggttcagaggccgaggaggcactggaggctgctggccgtttcctactgcctgggctggaggaggagctggaagaggccgtgggccgcatccacctgggaccccagggtggcccggagtcagtgggtgaggtgttccgcctgggccggccccggctggctgcccactgtgcccgctggacactggggtcagagcagtgcccgaggaagcggggtctggccctggtggggcttgtggaggcagcaggtgaagaggcagggcccctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaagccaaggccaggttctgggtgtagggcccagagaagcagaacagcccagagccccaggtgcctggcctggcctagacctctggaattgagattaaacaatttggagttggata

SEQ ID NO: 335497 - DNA, 656 bp, Homo sapiens
  misc_feature (22)..(22): n is a, c, g, or t
tctagaggacccccaagcagtnaaacagactcagctaattttgtatttttaatagaggcaggtttctccatgttggtcaggctggtctctaactcctgactcaggtgatccacctgccttggcctcccaaagtgctgggattacaggtgtgagccaccgcacctggcagcctgtttttcttaatctgtgtctcatctgaattttggatctaatcgtgcttcaaattgcaaagtccatgtggcaaaaccaacaattgcctgaaaggatttagtagatctagaaatgaaactaggaagattctaagtaaatttcattttagtttcactaatggaatttacttcccttgcctcccactgctggttgggatataatgataaatgtacatgacaagcctacctgaggattagaaaaatagaatctgtattgtatatgtcagaaatgcattcagctctaaatacaagatgctgaaacagatgggagtagatttatcttatacaaatagaaagttggggtgagcagtctaggccagtgcatcaggctgttccatgtttctgctccatcatcttagcacgtagacccttcttctcaggcttgttgtctcatgatcacaagatggctgccacacttccagatcttaagtctgtattccagtcagg

SEQ ID NO: 335498 - DNA, 253 bp, Homo sapiens
atctagataaagctcctctaatgttcgttcgaagttaaagacctcctttggcacctgctgaagactgcagtgggagtaatctaaaactgagatgatttcttcttcacctcggaaacatcggcatggcaccagacggccgatgattttccgtttggtggtcatctccaggcactgcactagagaaacgcagaaacaaaacaaaacaaaacagcttatccagtgcccttggaaggcattcttgtaatatttaaag

SEQ ID NO: 335499 - DNA, 113 bp, Homo sapiens
ttttgtatattttcttttcaaaaaactcttagcagttgtatgatagacctgctaggttgattctgtttctcatttcttctctcctagtttttgtcctgttgtgtttttacagt

SEQ ID NO: 335500 - DNA, 450 bp, Homo sapiens
attttgcctttgctgaagtaaacatatagtaatggctgaaaaccactgcgttatgtaaatacacttcctatgacttatttgtagtccttttgtatctagcaatttctacagaccctctctgtgggcttcggaagccagaatgggcagggccaggtgtgaggtgtcctaggacactgagggtagagcacagctcccagctcagggggacccatttctgaggctaaggcacccacctggggctcagcctatcttcagagggaaaatcacacctcagaacaccagacacccaaaagaaagctccagttcggcagatacctgccaatagaccctggagtggctgccccagggaaaactgccattgcactgtcagctccctccagccctctctcaggtcccagcaggagcagatttctgactaagctcagaggtctcaacaaatggcaggttgaa

SEQ ID NO: 335501 - DNA, 377 bp, Homo sapiens
atcggagtgtgtcaattgagtaatgaaaaacatgaatggcgttgaactttttcttgtcattgggaaattatttatacctgaggatggttggcaccaacagatatacattttacataggaaagagtaaatatttttctacaaaagagttgagcaaaagttgtcagttagctgaatatggtgctacagggaactataggatgttttctgtaaagaaatggtaatttggagaacaacatctgtctgttcacagccaaatcccctcgcctgccactgtgccttgagtgtaggtgatgttcagtgtgtctgttaaatggatgaccacgggagagcattggcagcacaaccgttggtttatttgtaatcaactctaacttatt

SEQ ID NO: 335502 - DNA, 158 bp, Homo sapiens
gtgtggcacggggaagggaaaggggtttagaactgtgtccaagctatttaggagagaaaggggagagtcccggggctgtgaaaggggcgaggaggagagagcagctgggccagggcgagcgtttgaccacacccactagccactccctcccagctgcc

SEQ ID NO: 335503 - DNA, 279 bp, Homo sapiens
catttattccaatgaaactagttgtgctaagattacctataactcccattcttcccagcaactttagagaaaatgttctttttaaaaaaatggaaactctgtgcttctagattctgcacaacacagtttcctctcctagtgttctttctgcctctcttttgttggaagaggaaatgttggggatcttacctgggctttctttttctcttctattgagaggcagtttggtgcagtgcctcaatctggaatcagactgagttgttatcatctggttattag

SEQ ID NO: 335504 - DNA, 172 bp, Homo sapiens
gtctgattttagagccatttagctttctggcagcaattgactctgtctgttaaatggtggctcttggaaaccagaacgagaggaggtggtagctgttggaaaagctgtcaaagctgttgtgagaaactgaagcagtgtggggaatccaggccccctgtttgtcactaaatgt

SEQ ID NO: 335505 - DNA, 536 bp, Homo sapiens
ggtgtgagcaataaggctgtttattttaactgggtgcaggcgggctgagtccgaaaagagagtcagcaaagggagataggggtggggctgttttataggatttggatgggtagcggaaaattacaaagggggtttttctcttacgggcaggggcgggggtcacaaggtgctcagtgggggaggttctgagccaggagaaggaatttcacaaggttaatcactcagttaaggtggggcaggaacaaatcacaatggtggaatgtcatcagttaaggcaggaaccggccaatttcccttcttttgtgattcttcacttgcttcaggccatctggatgtacacgtgcaggcttgggctcagaggcctgacagtcggccactagttaccaaagctggtggcaggctggagtctccagggaagctattgcattgattgattgactgattgacagggtcttggtctgtcacccaggctggagtgcagtgacgcgatcacagctcactgcagcctcaacctcccatgctcaagggatcctccc

SEQ ID NO: 335506 - DNA, 230 bp, Homo sapiens
ggctgcacagacaggaagagagaacaatggaaggaagacagcatattgtagcagtcagaagattaaactaaattctgactcttatttccaaattccaagctatcatttactagctgtgtgattttaaacaacttacttaaccattctgtgctttaatttcctcgagtataaaatggcaacaatgatagtaatttccttataggagttcatgagaagtgagattatctatc

SEQ ID NO: 335507 - DNA, 392 bp, Homo sapiens
cactgaggtggcactctgtgacttccttccctttgcaaacacatcagaggctggcagccacaccaggccctgctctggaggacaccagctggacctaacctgcccttggccatgctggtgctatggctagagatgtacaaatctccccctctcctgagccccaggggtagggggatctgtggcagcttggaggctcctaggcagggcacagcacagcttagtggtgctggagagtatccttcctaaatgatggctttgggtgtgaaatctctcctcagtcaaaggaaaggctttcttgtggctgctcccctttctgcttttgttcaggctgctgctgggtgagaaggagtttagggctagtgggaatacagcctcattaactggctagagca

SEQ ID NO: 335508 - DNA, 3945 bp, Homo sapiens
  misc_feature (3940)..(3945): n is a, c, g, or t
ccccgtgcgcctcttgcccgcagaccctgaggacacggccatgccgggccgggcggaggcgggggaggccgaggaggaggccggggccggctcggggtctgaggcggaggaggacgcgctgtgggagcgaatcgagggcgtccggcatcggctggctcgcgccctgaacccggccaagctcacgccgtatctgcgccagtgccgggtcatcgacgagcaggacgaggaggaggtgctgagcacctaccgcttcccgtgccgcgtcaaccgcaccgggcgcctgatggacatcttgcgctgccgtggcaagaggggctatgaggccttcctggaagccctggagttctactaccccgaacacttcacgctgctcacgggccaggaacccgcccagcgctgctccatgatcctcgatgaggaggggcctgagggcctgacccaattcttgatgacagaggtgcgacggctgcgggaagctcgcaagagccagctgcagcgggagcagcaactgcaggcccggggccgggtgctcgaggaggagcgggcagggctggagcagcggctgcgggaccagcagcaggctcaggagcgctgtcaacggctgcgggaggactgggaggcgggcagcctggagctgctgcggctcaaggatgagaactacatgatcgccatgcgcctggcacagctcagtgaggagaagaactcggctgtacttcgcagccgtgacctgcagctggcggtggatcagctcaagctcaaagtgagtcggctggaggaagagtgtgcactgcttcgaagggccaggggcccgccccctggggcagaggagaaggagaaggagaaggagaaggagaaggagccagacaatgtggaccttgtctctgagctgcgtgctgagaaccagcggctgacggcgtcactgcgggagttgcaggagggcctgcagcaggaggcgagccggccgggggccccgggctccgagcgcatcctgctggacatcctagagcatgactggcgggaggcgcaggacagcaggcaggagctgtgccagaagctgcatgccgtgcagggggagctgcagtgggccgaggagctgcgcgaccagtacctgcaggagatggaagacctgcggctcaagcaccgcacgctgcagaaggactgtgacctgtacaagcaccgcatggccactgtcctggcccaactggaggagattgagaaggagcgagaccaggccatccagagccgtgaccggatccagttgcagtactcacagagcctcatcgagaaggaccagtaccgcaagcaggtgcggggcctggaggcggagcgggatgagctgctgacaacgctcaccagcctggagggcaccaaggctctgctggaggttcagctgcagcgggcccagggtggcacctgcctcaaggcctgtgcctcctcccattccctgtgctccaacctcagcagcacttggagcctgagcgagttcccctcccctctgggaggcccagaagcaactggggaggcagctgtcatggggggacctgagcctcacaactcggaggaagccacagacagtgaaaaggagatcaatcggctctccatcctgcccttcccccccagtgccggctccatcctccgccggcagcgtgaggaagaccccgcaccccctaagagatccttcagcagcatgtcagacatcacagggagtgtgacacttaagccctggtcccctggcctctcttcgtcctcatcctctgacagcgtgtggcctttgggaaagccggaaggcctcctggctcggggctgtggcctggacttcctcaacaggtctctggctattcgggtgtctggccggagccccccagggggcccagagccgcaggacaagggaccagatggactgtcgttttatggggacagatggtctggggctgtggtgcgcagggtgctgtctgggcctgggtccgccaggatggaaccaagagagcaaagggtggaagctgctggtctggagggggcgtgcctggaagccgaggcccagcagagaaccttgctctggaatcaggggtccacactcccctccctgatggactcgaaggcctgccagtccttccacgaggccctagaagcctgggcaaagggaccaggtgccgagcccttctacattcgtgccaacctcaccttgcctgagagggcagatccccatgccctttgcgtgaaagcccaagagatccttcgactggtggactcggcatacaagcggaggcaggaatggttctgcacccgggttgaccccctcactctgcgggacctggaccggggcaccgtgcccaattatcagagagcccagcagctcctagaagttcaggagaaatgcctgccctccagccggcaccgaggcccccgcagtaatctgaagaagagagccctggaccagctgcggctggtgaggcccaagcccgtgggggcgcctgcaggggactccccggatcagctgctgctggagccctgtgcagagccggagcggagcctcagaccctacagtttggtgcggccgctactggtgtctgccctgcggcccgtggtgctgttgcctgagtgcctggcgccccggctcatccgtaacctgctagacctgcccagctcccggctggacttccaagtgtgcccagcggaaagcctctctggggaggaactgtgcccatcctcagcgcctggagcccccaaggctcagcctgccacccctgggctaggcagcaggatccgggccatccaggagtctgttgggaagaagcactgcctgctggagctgggtgctcggggtgtgcgggagctggtgcagaacgagatctaccccatcgtcatccacgtggaggtgactgagaagaatgtccgggaagtcaggggtctgctgggccggccgggctggcgggactcagagctgctgcggcagtgccgtggctcagagcaggtgctctgggggctgccctgctcctgggtgcaggtgcccgcccatgagtggggacacgcagaggagctggccaaggtggtgcgcggccgcatcctgcaggagcaggcccgcctcgtgtgggtggagtgcggcagcagcagaggctgccccagcagcagtgaggcctgaggctcatctgatacctgcaccttctccccaagccagcgtggaccctggtgtctatggtgaagctgggccctcccaccctgagccttcctagacccttggactctcagatgcagggcccttggctctggcctctcacccccaaggctgtctctggccctgccgagcctatgggagtcccgggacagagtgcccactcccctctacttgctgctctgggcctccccacctttcctggggtctccacattcccactagtgggtcttatgtgtgtctgtgtcttctccttaaacactcgccctggagtctgttctcacacctgtgcgcaggtttgcacactcaagttctcatgggcaggctcaggtctgtcccgctgccctgggcacgaggtctcctgaggacctgggcctgttctgctcctaggagacctgagcccgttaccgcgtgactcccaccatccagctcgcgctcctcgtggattcagccatgcatggactggggtgttccctggcccatggtcacctgtgcccctcgtgtctcctcacatgggtgtctgtggttctctcctgtgtaaatgtcacgccccacccctgtttcatgtgggcactaacacgtgtgcgttcctggcgggcacactcaggaccgtgcctcacagggcccactccctgcctatgcctccctcttggggggccgaggagggcggctgctctgtcatgagaatgtacggcccgtggatgattaacgggcctttttcacttagaagctgcacattatggagcattaaacacttttgtcatagaaaannnnnn

SEQ ID NO: 335509 - DNA, 3955 bp, Homo sapiens
  misc_feature (3950)..(3955): n is a, c, g, or t
acccgggagcccgaggcgactgtagcgtgcgggaccctgaggacacggccatgccgggccgggcggaggcgggggaggccgaggaggaggccggggccggctcggggtctgaggcggaggaggacgcgctgtgggagcgaatcgagggcgtccggcatcggctggctcgcgccctgaacccggccaagctcacgccgtatctgcgccagtgccgggtcatcgacgagcaggacgaggaggaggtgctgagcacctaccgcttcccgtgccgcgtcaaccgcaccgggcgcctgatggacatcttgcgctgccgtggcaagaggggctatgaggccttcctggaagccctggagttctactaccccgaacacttcacgctgctcacgggccaggaacccgcccagcgctgctccatgatcctcgatgaggaggggcctgagggcctgacccaattcttgatgacagaggtgcgacggctgcgggaagctcgcaagagccagctgcagcgggagcagcaactgcaggcccggggccgggtgctcgaggaggagcgggcagggctggagcagcggctgcgggaccagcagcaggctcaggagcgctgtcaacggctgcgggaggactgggaggcgggcagcctggagctgctgcggctcaaggatgagaactacatgatcgccatgcgcctggcacagctcagtgaggagaagaactcggctgtacttcgcagccgtgacctgcagctggcggtggatcagctcaagctcaaagtgagtcggctggaggaagagtgtgcactgcttcgaagggccaggggcccgccccctggggcagaggagaaggagaaggagaaggagaaggagaaggagccagacaatgtggaccttgtctctgagctgcgtgctgagaaccagcggctgacggcgtcactgcgggagttgcaggagggcctgcagcaggaggcgagccggccgggggccccgggctccgagcgcatcctgctggacatcctagagcatgactggcgggaggcgcaggacagcaggcaggagctgtgccagaagctgcatgccgtgcagggggagctgcagtgggccgaggagctgcgcgaccagtacctgcaggagatggaagacctgcggctcaagcaccgcacgctgcagaaggactgtgacctgtacaagcaccgcatggccactgtcctggcccaactggaggagattgagaaggagcgagaccaggccatccagagccgtgaccggatccagttgcagtactcacagagcctcatcgagaaggaccagtaccgcaagcaggtgcggggcctggaggcggagcgggatgagctgctgacaacgctcaccagcctggagggcaccaaggctctgctggaggttcagctgcagcgggcccagggtggcacctgcctcaaggcctgtgcctcctcccattccctgtgctccaacctcagcagcacttggagcctgagcgagttcccctcccctctgggaggcccagaagcaactggggaggcagctgtcatggggggacctgagcctcacaactcggaggaagccacagacagtgaaaaggagatcaatcggctctccatcctgcccttcccccccagtgccggctccatcctccgccggcagcgtgaggaagaccccgcaccccctaagagatccttcagcagcatgtcagacatcacagggagtgtgacacttaagccctggtcccctggcctctcttcgtcctcatcctctgacagcgtgtggcctttgggaaagccggaaggcctcctggctcggggctgtggcctggacttcctcaacaggtctctggctattcgggtgtctggccggagccccccagggggcccagagccgcaggacaagggaccagatggactgtcgttttatggggacagatggtctggggctgtggtgcgcagggtgctgtctgggcctgggtccgccaggatggaaccaagagagcaaagggtggaagctgctggtctggagggggcgtgcctggaagccgaggcccagcagagaaccttgctctggaatcaggggtccacactcccctccctgatggactcgaaggcctgccagtccttccacgaggccctagaagcctgggcaaagggaccaggtgccgagcccttctacattcgtgccaacctcaccttgcctgagagggcagatccccatgccctttgcgtgaaagcccaagagatccttcgactggtggactcggcatacaagcggaggcaggaatggttctgcacccgggttgaccccctcactctgcgggacctggaccggggcaccgtgcccaattatcagagagcccagcagctcctagaagttcaggagaaatgcctgccctccagccggcaccgaggcccccgcagtaatctgaagaagagagccctggaccagctgcggctggtgaggcccaagcccgtgggggcgcctgcaggggactccccggatcagctgctgctggagccctgtgcagagccggagcggagcctcagaccctacagtttggtgcggccgctactggtgtctgccctgcggcccgtggtgctgttgcctgagtgcctggcgccccggctcatccgtaacctgctagacctgcccagctcccggctggacttccaagtgtgcccagcggaaagcctctctggggaggaactgtgcccatcctcagcgcctggagcccccaaggctcagcctgccacccctgggctaggcagcaggatccgggccatccaggagtctgttgggaagaagcactgcctgctggagctgggtgctcggggtgtgcgggagctggtgcagaacgagatctaccccatcgtcatccacgtggaggtgactgagaagaatgtccgggaagtcaggggtctgctgggccggccgggctggcgggactcagagctgctgcggcagtgccgtggctcagagcaggtgctctgggggctgccctgctcctgggtgcaggtgcccgcccatgagtggggacacgcagaggagctggccaaggtggtgcgcggccgcatcctgcaggagcaggcccgcctcgtgtgggtggagtgcggcagcagcagaggctgccccagcagcagtgaggcctgaggctcatctgatacctgcaccttctccccaagccagcgtggaccctggtgtctatggtgaagctgggccctcccaccctgagccttcctagacccttggactctcagatgcagggcccttggctctggcctctcacccccaaggctgtctctggccctgccgagcctatgggagtcccgggacagagtgcccactcccctctacttgctgctctgggcctccccacctttcctggggtctccacattcccactagtgggtcttatgtgtgtctgtgtcttctccttaaacactcgccctggagtctgttctcacacctgtgcgcaggtttgcacactcaagttctcatgggcaggctcaggtctgtcccgctgccctgggcacgaggtctcctgaggacctgggcctgttctgctcctaggagacctgagcccgttaccgcgtgactcccaccatccagctcgcgctcctcgtggattcagccatgcatggactggggtgttccctggcccatggtcacctgtgcccctcgtgtctcctcacatgggtgtctgtggttctctcctgtgtaaatgtcacgccccacccctgtttcatgtgggcactaacacgtgtgcgttcctggcgggcacactcaggaccgtgcctcacagggcccactccctgcctatgcctccctcttggggggccgaggagggcggctgctctgtcatgagaatgtacggcccgtggatgattaacgggcctttttcacttagaagctgcacattatggagcattaaacacttttgtcatagaaaannnnnn

SEQ ID NO: 335510 - DNA, 3507 bp, Homo sapiens
  misc_feature (3407)..(3408): n is a, c, g, or t
  misc_feature (3426)..(3426): n is a, c, g, or t
  misc_feature (3442)..(3442): n is a, c, g, or t
  misc_feature (3476)..(3476): n is a, c, g, or t
acccgggagcccgaggcgactgtagcgtgcgggaccctgaggacacggccatgccgggccgggcggaggcgggggaggccgaggaggaggccggggccggctcggggtctgaggcggaggaggacgcgctgtgggagcgaatcgagggcgtccggcatcggctggctcgcgccctgaacccggccaagctcacgccgtatctgcgccagtgccgggtcatcgacgagcaggacgaggaggaggtgctgagcacctaccgcttcccgtgccgcgtcaaccgcaccgggcgcctgatggacatcttgcgctgccgtggcaagaggggctatgaggccttcctggaagccctggagttctactaccccgaacacttcacgctgctcacgggccaggaacccgcccagcgctgctccatgatcctcgatgaggaggggcctgagggcctgacccaattcttgatgacagaggtgcgacggctgcgggaagctcgcaagagccagctgcagcgggagcagcaactgcaggcccggggccgggtgctcgaggaggagcgggcagggctggagcagcggctgcgggaccagcagcaggctcaggagcgctgtcaacggctgcgggaggactgggaggcgggcagcctggagctgctgcggctcaaggatgagaactacatgatcgccatgcgcctggcacagctcagtgaggagaagaactcggctgtacttcgcagccgtgacctgcagctggcggtggatcagctcaagctcaaagtgagtcggctggaggaagagtgtgcactgcttcgaagggccaggggcccgccccctggggcagaggagaaggagaaggagaaggagaaggagaaggagccagacaatgtggaccttgtctctgagctgcgtgctgagaaccagcggctgacggcgtcactgcgggagttgcaggagggcctgcagcaggaggcgagccggccgggggccccgggctccgagcgcatcctgctggacatcctagagcatgactggcgggaggcgcaggacagcaggcaggagctgtgccagaagctgcatgccgtgcagggggagctgcagtgggccgaggagctgcgcgaccagtacctgcaggagatggaagacctgcggctcaagcaccgcacgctgcagaaggactgtgacctgtacaagcaccgcatggccactgtcctggcccaactggaggagattgagaaggagcgagaccaggccatccagagccgtgaccggatccagttgcagtactcacagagcctcatcgagaaggaccagtaccgcaagcaggtgcggggcctggaggcggagcgggatgagctgctgacaacgctcaccagcctggagggcaccaaggctctgctggaggttcagctgcagcgggcccagggtggcacctgcctcaaggcctgtgcctcctcccattccctgtgctccaacctcagcagcacttggagcctgagcgagttcccctcccctctgggaggcccagaagcaactggggaggcagctgtcatggggggacctgagcctcacaactcggaggaagccacagacagtgaaaaggagatcaatcggctctccatcctgcccttcccccccagtgccggctccatcctccgccggcagcgtgaggaagaccccgcaccccctaagagatccttcagcagcatgtcagacatcacagggagtgtgacacttaagccctggtcccctggcctctcttcgtcctcatcctctgacagcgtgtggcctttgggaaagccggaaggcctcctggctcggggctgtggcctggacttcctcaacaggtctctggctattcgggtgtctggccggagccccccagggggcccagagccgcaggacaagggaccagatggactgtcgttttatggggacagatggtctggggctgtggtgcgcagggtgctgtctgggcctgggtccgccaggatggaaccaagagagcaaagggtggaagctgctggtctggagggggcgtgcctggaagccgaggcccagcagagaaccttgctctggaatcaggggtccacactcccctccctgatggactcgaaggcctgccagtccttccacgaggccctagaagcctgggcaaagggaccaggtgccgagcccttctacattcgtgccaacctcaccttgcctgagagggcagatccccatgccctttgcgtgaaagcccaagagatccttcgactggtggactcggcatacaagcggaggcaggaatggttctgcacccgggttgaccccctcactctgcgggacctggaccggggcaccgtgcccaattatcagagagcccagcagctcctagaagttcaggagaaatgcctgccctccagccggcaccgaggcccccgcagtaatctgaagaagagagccctggaccagctgcggctggtgaggcccaagcccgtgggggcgcctgcaggggactccccggatcagctgctgctggagccctgtgcagagccggagcggagcctcagaccctacagtttggtgcggccgctactggtgtctgccctgcggcccgtggtgctgttgcctgagtgcctggcgccccggctcatccgtaacctgctagacctgcccagctcccggctggacttccaagtgtgcccagcggaaagcctctctggggaggaactgtgcccatcctcagcgcctggagcccccaaggctcagcctgccacccctgggctaggcagcaggatccgggccatccaggagtctgttgggaagaagcactgcctgctggagctgggtgctcggggtgtgcgggagctggtgcagaacgagatctaccccatcgtcatccacgtggaggtgactgagaagaatgtccgggaagtcaggggtctgctgggccggccgggctggcgggactcagagctgctgcggcagtgccgtggctcagagcaggtgctctgggggctgccctgctcctgggtgcaggtgcccgcccatgagtggggacacgcagaggagctggccaaggtggtgcgcggccgcatcctgcaggagcaggcccgcctcgtgtgggtggagtgcggcagcagcagaggctgccccagcagcagtgaggcctgaggctcatctgatacctgcaccttctccccaagccagcgtggaccctggtgtctatggtgaagctgggccctcccaccctgagccttcctagacccttggactctcagatgcagggcccttggctctggcctctcacccccaaggctgtctctggccctgccgagcctatgggagtcccgggacagagtgcccactcccctctacttgctgctctgggcctccccacctttcctggggtctccacattcccactagtgnnggtctttaaatttggggnttgggttttggttttncctttgggtttggggttttccccctttttttttncccccttttttttcccccccccccccccccc

SEQ ID NO: 335511 - DNA, 743 bp, Homo sapiens
gacccacccaagaacagggtttgtgtgggtataatactaagttgagatgatatcatttacggggtactgcactcatgtgaggtaggactcatatctcttgtgctgatctcgatctcaaaacttcatgtatgatagctgcacaggccgagcctagaatgaggcgctagtaactgccgaccataccatgcacggagattgaagacctgcgtgctcgaaagaacaaccagggatcagctgacaatagagggaactgtgacccttgtatcgaatgcacccggacactgggcctaatctgtttcgctggacaccatgaggtggaagagcaggacttgaggaacgcgagcgagagcaggccatccagagccgtgaccggatccagttgcagtactcacagagcctcatcgagaaggaccagtaccgcaagcaggtgcggggcctggaggcggagcgggatgagctgctgacaacgctcaccagcctggagggcaccaaggctctgctggaggttcagctgcagcgggcccagggtggcacctgcctcaaggcctgtgcctcctcccattccctgtgctccaacctcagcagcacttggagcctgagcgagttcccctcccctctgggaggcccagaagcaactggggaggcagctgtcatggggggacctgagcctcacaactcggaagaagaccacagacacgtgaacacaggagatcaattcggtctccatacctggccttacccca

SEQ ID NO: 335512 - DNA, 3525 bp, Homo sapiens
  misc_feature (3520)..(3525): n is a, c, g, or t
tgcactcatagtccagcaaactggccatgcacgtctgctcccagcttggtggtcacaccacagctgcccaccccccataccaggccaacttctggctgcacactccgaactggtgattggttaggggcatgggattttgtttgaagctgtgaagacagccacggtcacactgtggcagctctgtagcccttcatagtttagaggcctctgcccacttgctgtcttgtttgattcttgcaacacctttgggaggcaaatgatggggccaggggattgactgggcccattttactgatgaggaaactgaggcccagaggaggtggatcagctcaagctcaaagtgagtcggctggaggaagagtgtgcactgcttcgaagggccaggggcccgccccctggggcagaggagaaggagaaggagaaggagaaggagaaggagccagacaatgtggaccttgtctctgagctgcgtgctgagaaccagcggctgacggcgtcactgcgggagttgcaggagggcctgcagcaggaggcgagccggccgggggccccgggctccgagcgcatcctgctggacatcctagagcatgactggcgggaggcgcaggacagcaggcaggagctgtgccagaagctgcatgccgtgcagggggagctgcagtgggccgaggagctgcgcgaccagtacctgcaggagatggaagacctgcggctcaagcaccgcacgctgcagaaggactgtgacctgtacaagcaccgcatggccactgtcctggcccaactggaggagattgagaaggagcgagaccaggccatccagagccgtgaccggatccagttgcagtactcacagagcctcatcgagaaggaccagtaccgcaagcaggtgcggggcctggaggcggagcgggatgagctgctgacaacgctcaccagcctggagggcaccaaggctctgctggaggttcagctgcagcgggcccagggtggcacctgcctcaaggcctgtgcctcctcccattccctgtgctccaacctcagcagcacttggagcctgagcgagttcccctcccctctgggaggcccagaagcaactggggaggcagctgtcatggggggacctgagcctcacaactcggaggaagccacagacagtgaaaaggagatcaatcggctctccatcctgcccttcccccccagtgccggctccatcctccgccggcagcgtgaggaagaccccgcaccccctaagagatccttcagcagcatgtcagacatcacagggagtgtgacacttaagccctggtcccctggcctctcttcgtcctcatcctctgacagcgtgtggcctttgggaaagccggaaggcctcctggctcggggctgtggcctggacttcctcaacaggtctctggctattcgggtgtctggccggagccccccagggggcccagagccgcaggacaagggaccagatggactgtcgttttatggggacagatggtctggggctgtggtgcgcagggtgctgtctgggcctgggtccgccaggatggaaccaagagagcaaagggtggaagctgctggtctggagggggcgtgcctggaagccgaggcccagcagagaaccttgctctggaatcaggggtccacactcccctccctgatggactcgaaggcctgccagtccttccacgaggccctagaagcctgggcaaagggaccaggtgccgagcccttctacattcgtgccaacctcaccttgcctgagagggcagatccccatgccctttgcgtgaaagcccaagagatccttcgactggtggactcggcatacaagcggaggcaggaatggttctgcacccgggttgaccccctcactctgcgggacctggaccggggcaccgtgcccaattatcagagagcccagcagctcctagaagttcaggagaaatgcctgccctccagccggcaccgaggcccccgcagtaatctgaagaagagagccctggaccagctgcggctggtgaggcccaagcccgtgggggcgcctgcaggggactccccggatcagctgctgctggagccctgtgcagagccggagcggagcctcagaccctacagtttggtgcggccgctactggtgtctgccctgcggcccgtggtgctgttgcctgagtgcctggcgccccggctcatccgtaacctgctagacctgcccagctcccggctggacttccaagtgtgcccagcggaaagcctctctggggaggaactgtgcccatcctcagcgcctggagcccccaaggctcagcctgccacccctgggctaggcagcaggatccgggccatccaggagtctgttgggaagaagcactgcctgctggagctgggtgctcggggtgtgcgggagctggtgcagaacgagatctaccccatcgtcatccacgtggaggtgactgagaagaatgtccgggaagtcaggggtctgctgggccggccgggctggcgggactcagagctgctgcggcagtgccgtggctcagagcaggtgctctgggggctgccctgctcctgggtgcaggtgcccgcccatgagtggggacacgcagaggagctggccaaggtggtgcgcggccgcatcctgcaggagcaggcccgcctcgtgtgggtggagtgcggcagcagcagaggctgccccagcagcagtgaggcctgaggctcatctgatacctgcaccttctccccaagccagcgtggaccctggtgtctatggtgaagctgggccctcccaccctgagccttcctagacccttggactctcagatgcagggcccttggctctggcctctcacccccaaggctgtctctggccctgccgagcctatgggagtcccgggacagagtgcccactcccctctacttgctgctctgggcctccccacctttcctggggtctccacattcccactagtgggtcttatgtgtgtctgtgtcttctccttaaacactcgccctggagtctgttctcacacctgtgcgcaggtttgcacactcaagttctcatgggcaggctcaggtctgtcccgctgccctgggcacgaggtctcctgaggacctgggcctgttctgctcctaggagacctgagcccgttaccgcgtgactcccaccatccagctcgcgctcctcgtggattcagccatgcatggactggggtgttccctggcccatggtcacctgtgcccctcgtgtctcctcacatgggtgtctgtggttctctcctgtgtaaatgtcacgccccacccctgtttcatgtgggcactaacacgtgtgcgttcctggcgggcacactcaggaccgtgcctcacagggcccactccctgcctatgcctccctcttggggggccgaggagggcggctgctctgtcatgagaatgtacggcccgtggatgattaacgggcctttttcacttagaagctgcacattatggagcattaaacacttttgtcatagaaaannnnnn

SEQ ID NO: 335513 - DNA, 2754 bp, Homo sapiens
acccgggagcccgaggcgactgtagcgtgcgggaccctgaggacacggccatgccgggccgggcggaggcgggggaggccgaggaggaggccggggccggctcggggtctgaggcggaggaggacgcgctgtgggagcgaatcgagggcgtccggcatcggctggctcgcgccctgaacccggccaagctcacgccgtatctgcgccagtgccgggtcatcgacgagcaggacgaggaggaggtgctgagcacctaccgcttcccgtgccgcgtcaaccgcaccgggcgcctgatggacatcttgcgctgccgtggcaagaggggctatgaggccttcctggaagccctggagttctactaccccgaacacttcacgctgctcacgggccaggaacccgcccagcgctgctccatgatcctcgatgaggaggggcctgagggcctgacccaattcttgatgacagaggtgcgacggctgcgggaagctcgcaagagccagctgcagcgggagcagcaactgcaggcccggggccgggtgctcgaggaggagcgggcagggctggagcagcggctgcgggaccagcagcaggctcaggagcgctgtcaacggctgcgggaggactgggaggcgggcagcctggagctgctgcggctcaaggatgagaactacatgatcgccatgcgcctggcacagctcagtgaggagaagaactcggctgtacttcgcagccgtgacctgcagctggcggtggatcagctcaagctcaaagtgagtcggctggaggaagagtgtgcactgcttcgaagggccaggggcccgccccctggggcagaggagaaggagaaggagaaggagaaggagaaggagccagacaatgtggaccttgtctctgagctgcgtgctgagaaccagcggctgacggcgtcactgcgggagttgcaggagggcctgcagcaggaggcgagccggccgggggccccgggctccgagcgcatcctgctggacatcctagagcatgactggcgggaggcgcaggacagcaggcaggagctgtgccagaagctgcatgccgtgcagggggagctgcagtgggccgaggagctgcgcgaccagtacctgcaggagatggaagacctgcggctcaagcaccgcacgctgcagaaggactgtgacctgtacaagcaccgcatggccactgtcctggcccaactggaggagattgagaaggagcgagaccaggccatccagagccgtgaccggatccagttgcagtactcacagagcctcatcgagaaggaccagtaccgcaagcaggtgcggggcctggaggcggagcgggatgagctgctgacaacgctcaccagcctggagggcaccaaggctctgctggaggttcagctgcagcgggcccagggtggcacctgcctcaaggcctgtgcctcctcccattccctgtgctccaacctcagcagcacttggagcctgagcgagttcccctcccctctgggaggcccagaagcaactggggaggcagctgtcatggggggacctgagcctcacaactcggaggaagccacagacagtgaaaaggagatcaatcggctctccatcctgcccttcccccccagtgccggctccatcctccgccggcagcgtgaggaagaccccgcaccccctaagagatccttcagcagcatgtcagacatcacagggagtgtgacacttaagccctggtcccctggcctctcttcgtcctcatcctctgacagcgtgtggcctttgggaaagccggaaggcctcctggctcggggctgtggcctggacttcctcaacaggtctctggctattcgggtgtctggccggagccccccagggggcccagagccgcaggacaagggaccagatggactgtcgttttatggggacagatggtctggggctgtggtgcgcagggtgctgtctgggcctgggtccgccaggatggaaccaagagagcaaagggtggaagctgctggtctggagggggcgtgcctggaagccgaggcccagcagagaaccttgctctggaatcaggggtccacactcccctccctgatggactcgaaggcctgccagtccttccacgaggccctagaagcctgggcaaagggaccaggtgccgagcccttctacattcgtgccaacctcaccttgcctgagagggcagatccccatgccctttgcgtgaaagcccaagagatccttcgactggtggactcggcatacaagcggaggcaggaatggttctgcacccgggttgaccccctcactctgcgggacctggaccggggcaccgtgcccaattatcagagagcccagcagctcctagaagttcaggagaaatgcctgccctccagccggcaccgaggcccccgcagtaatctgaagaagagagccctggaccagctgcggctggtgaggcccaagcccgtgggggcgcctgcaggggactccccggatcagctgctgctggagccctgtgcagagccggagcggagcctcagaccctacagtttggtgcggccgctactggtgtctgccctgcggcccgtggtgctgttgcctgagtgcctggcgccccggctcatccgtaacctgctagacctgcccagctcccggctggacttccaagtgtgcccagcggaagcctctctggggaggaactgtgcccatcctcacaccaagcaccagcacgaagttcagcaccagcacg

SEQ ID NO: 335514 - DNA, 366 bp, Homo sapiens
tgtgttctagaaaacctggttactgggtacatttatgattgttttccacagacaaaatattgacattctaagtcctttccttattaactatttactgaatatcaatggtggtagctccctagtcattcatttattcaacaaacatttgtgcctaccctgcgctaggccctgttctgggtgcaaataaatatctgaaggactgtatgtacagatggactcaattcaatctttcttataatcagtttgagttactgtgcaacatcgcttaagtcattaaactgaaagtcattgaaacacaagactgaaaaatgtaaggatgaagtactttcacatacaaagggatttctgccatactttcaaatagct

SEQ ID NO: 335515 - DNA, 458 bp, Homo sapiens
gatgtgtgttttagattcatgtaattttttgagagatgctagaagaatatcaaaactatgatatttctcttagacctcataaccttgaaaattcccaaatgatatttcttaaggtgctttgagaattacagactccttaaggttagtccctaacaacacactgggaagcttgctaggggagcatatgtgtaactcctagggaaacaggaagaagaaggattactgtgtctttgagcccactgccccagggtagattgtcctaccttgggaggatatgtcttctgttgtgtttttcaggggagaaagtgcagagggatgaaggaagaaagactgttgctgaaaagattcaggaaagagaatagatgttttcacaataccgttagaagtaagaccgagtgattatcaggggagccaacttattcacctgctcaatatggtgatgaacagagagaatgctc

SEQ ID NO: 335516 - DNA, 419 bp, Homo sapiens
aagtgcaaatggccaaaaatagccaaaacaattcataagattttaagaatttgaaggcattcatcctaccacatattagtaattacaaggctatactcattaaggttatatctccactgattagaaggatgagatgagataaataaataagagcataactatagtcattaaactagtgtggaactgactcagggatagacaaatcaaagcaactgaattgcagatttcataaacatcctcctgtgtcagaaagataaaaaaaagtatgggctattaaatatatgatgctggttatccatatggaaaaataatgaaattagatccttacatacaaaaataaattacaggtggattaaaggcctaaatgtaaaacaataacctcaataaaacaatgaaaaacaaaagaaagcttgtaatcc

SEQ ID NO: 335517 - DNA, 154 bp, Homo sapiens
ggtcattctcagggtgtgcttgagttattgcattctggcgcatctgccacacaccttcctacactccttcatccctatggaattacgatataattttggttagattcatagtcaccctatatcattaagacagggaaatactttagatcagtta

SEQ ID NO: 335518 - DNA, 317 bp, Homo sapiens
accaggtgttattgtcagaatccaaaggctaagagctcagtttcacaagtctgccccctactttagacaccagttgcaattaatggtcatctatacttctgattgactggctatatattggggtctccattagctcctctttgggttggattaagttgctaggacagcttacagatattataaaggatacagaagaacagccagatggaagagacttaatagggcaaggtgtgggagaaagggtgaggagcttccatgccctctctgggcatgccaccctcctaacacctcagtcccagggtgaagttccagcaact

SEQ ID NO: 335519 - DNA, 459 bp, Homo sapiens
tctgggaaaatgtctgggtgcacagtctaaagaggaaatgcaatagaaacctgaaatttctctaagcgcagcagaggttccagcgaagttcctttatggaataactacctcaggagtccttaatacgtgttgttgattgagtgactcttcccagggggagagtgtatctgttggttggctggattctcatcagagccagagctctgccctccctctggctgtgtatgagagtttttgtttcctttgtaaactccctttcctgaggaacaatgaggctcacttgctagggcatgcctctgtctctagatgtgtttgtgtggggctgagcgtttagtcggttggtttgtgcgttagtcaacctgtggcagtacctgtgtgtttatctgattcttgagtgtgcgtgtcgttgtgtgagtagttgtgtcagtatgtgttctacatgagtctccccccaccccc

SEQ ID NO: 335520 - DNA, 649 bp, Homo sapiens
tatacttaaaaggagaataaatcctcagcctaaacagatcttccaccaaagacagaatcctaatggagaagaggtggaattctgagacttgggatagtgacatttcagtggatgagctaaaaaatcttggacccttcccaaatttcctagaatctcctggctggaaacaacaacaacaacaacaacaacaacaacaacaacaacaacacaaaacaaaacaacccagaaaacaaaacctccccattgccagaggagaattctggaatgacttttctgaagcagatgactttaaagacaatgtctgttttccacaagacttattgtcaccaccattcattgctcctagatatgtaacagaaatcaagtcttggccgggcgtggtggctcacgcctgtaatcccagcactttgggaggccaaggcgggcagatcacgaggtcaggagatcgagaccatcctggctaacatggtgaaaccctgtgtctactaaaaatacaaaaattagccaggtgtggtggcgggcacctgtagtcccagctacttgggagactcaggcaggagaatggcgtgaacctgggaggcagagcttgcagtgagccaagattgcgccactgcactccagcctgggcaacagagcaagactccgtctc

SEQ ID NO: 335521 - DNA, 378 bp, Homo sapiens
actctgccggcttataactcaagaaatttgctgtattatgaagctaggaggctaaaatcaagcagaaatcccatgaaaatcagggaagaattccagccatattgtgatgctctgtagataggagatagagtttagagtgtgctgggtaaaggaatcctggtaaatcctggttctcaattaacatctgtgtaaggctaggacctaggagccaggagcctttctaaagtactatggcctggccaggagttaatttggtctcttaattggattagtgtggtcagccaacaagctgtgtcatagagagataatatgatccaaagctataaaatataaatgataagtgaacttcatatcagtagcaataattatccaacagaa

SEQ ID NO: 335522 - DNA, 380 bp, Homo sapiens
taactttgctgtcattcagcagatgagatctcagcaatccccactaggctggcttctaataacgctctcccactttaagccatgctcaaatctgagccgactccccaccattctaacagactaaggaacagagaaattggcaattctaaactatgcttttttacttttttgaatttgaccaaaataaatacagtgatacttagaaaattatagtcatgcatatccttatcgctctaattccccattatctaactagaatgttaggtagacagggcacttagaactgaaaattgacaaaaccatgctaaatggcagctcttttgtaggagagtcaaagattgtagttgggcagttgaaaagcataacctctaaatttaatc

SEQ ID NO: 335523 - DNA, 287 bp, Homo sapiens
gacacaattcagttcatagtaacctgcaaggagacatatcaggggcacattcttgtcacacggccaaacttccattgcaaaatgactacattacaatggatctttatatgagtgtctagcatattgttgcaattatttgatgaactatcattttgaatttgttcagctgcacttgtggaggaggaggggtaggagatgaaaaagaagaagagcatcgattatgtactcactctgtatcaagcactgttctaagtacttttgcatgcatcactacttcgtccagtttt

SEQ ID NO: 335524 - DNA, 400 bp, Homo sapiens
atttcataatatcctttgagggagatgaacataccacagggtgttgcaaaacaaaggctgaaaatcatagtttcagaggttctgttaactgattttatttttatccctccaaatttctctaaattttttttctactttttaaaattttaatctaaagtgtattttctagtcctggaaagctgcaagtcccttaagggatacagaaccttaaaggaaatctgttcatctaacaaacatgtattgtatacccctacataccaggcactcttcaaattaccaggatatagcagtgaacaaattccactctctcctgaagctgccaatccagtgaaaagacaaggatgactcattatcccagtttgcctgggactgcccttttttaactctgaatgtcctgcat

SEQ ID NO: 335525 - DNA, 297 bp, Homo sapiens
atcacaagtacatttcatagccccctgacttcattgggagttgtggataatttataaagacacagatttgttttctcgcagtctggaagctgggaagtccaagatggaagggttggcatctggtgagggccttcttgctccattatcccatggtgggaagtggaagggcaaagaggggagtgggagagagagaaagggggccaaaactcatccttttataaggaacccactcccacaatcatggcatttatcgatccatgaaggtggtgcccccatgacccaaacaccttctattag

SEQ ID NO: 335526 - DNA, 301 bp, Homo sapiens
ggggagtccctggaccttggtctgaggggtccctcccttgctcaaggtataatcaagtccctgcttgagggactccctattttccctgagatataatccagacttctcagctcggttttcagggcccttcttccaaattccagtaggatcctccttgccaacagttccttcctatgtgctcaggagctcagctgactgaacaacccactccatggcctctacctgttagactgccttgcctgtgtttctcaaagttcccctgcctggtgtgccttcccctcagcccggtgcctgcctgtgg

SEQ ID NO: 335527 - DNA, 190 bp, Homo sapiens
gcccttctgccagattgtctagtgtcaatttgttttctggcactgcttcacctcagttttcttcctcatcaccttgcactggtttggaaggactcatccccatcaaattggcttttgttaactactctggtgtgtctgttagctcttgaatttcttcaagatatcttgagacccttcaccccgacccccc

SEQ ID NO: 335528 - DNA, 153 bp, Homo sapiens
acccgggctcagggtcacgcaggctctgtccacacacctgggctcagggtcacgcaggctctgtccacacacctgggctcagggtcacgcaggctgtatccgcacacctgggctcagggtcacgtgggctgtatccacacacccgggctcagg

SEQ ID NO: 335529 - DNA, 216 bp, Homo sapiens
ctgtggcgaatcctcctcctcctaaccctagtcctaatcacataacctattcccccgagcaatctcaattacaacatatacaccaacaaacaatgttcaaccagtaactactactaatcaacgcccataatcatacaaagcccccgcaccaaaaggaattcctccccccacccccatcccactgcctcacctggctcctgcgtcggctaagccaca

SEQ ID NO: 335530 - DNA, 238 bp, Homo sapiens
acggatggcgaacgtgcaggtcgccgtgcgggtccggccgctcagcaagagggagaccaaagaagggggaagaattattgtggaagttgatggcaaagtggcaaaaatcaggaatttaaaggtggacaatcgaccagatggctttggggactcccgggagaaggttatggcatttggctttgattactgctactggtcagtcaacccagaggatccccagtatgcatctcaagatgtg

SEQ ID NO: 335531 - DNA, 88 bp, Homo sapiens
ccccttttttgtccctcaacttgagatgtatgaaggctttcggtctccctgggagtgggtggaggcagccagggcttacctgtacact

SEQ ID NO: 335532 - DNA, 417 bp, Homo sapiens
gtgacatttaaattttgttggaaaacactgtgtggtccaaacttgccttagctctgagaacctttctcacttggaatcatcaatttttgtattgcctctgaagcccgctttgccattcagtttctccccaattcacctttaacaagaacctgctcaactcttagggtaattaaattgcaaaccaatggcttcaaatgcaggttgagagaggttaagatactagaggttccaaactacttaaatgtttggaaagggctgttgtagcaacacctctcaagggctccttgggcattccttgcatatagtcacccctcccctccccagagagagacagatgtcattggacacccatgacatgtgcatccctgttccctgtgcctgacactgagaggacactaagatttctttctttctttt

SEQ ID NO: 335533 - DNA, 483 bp, Homo sapiens
agtatctcaatagcgtaacgaaaaatagtaactgatttcattcttacatcacaatttaatgtgggtgccgggggagtggaagaatctctgctccaagcagtgattcaaggaaccagccttcttccatctagtgattcctcaatgccttaggccttggagtcctctactggatggtctgcatgcagccagcctacagtggaaggtagtaatccatacagagaactcagtagatagttccttaaggatcaggcctagaagtcgcatccattacttctgcccacacctaacttggaaaggaggctgagaaacgtaatctaactctgttctcagaaagaaagagaaacgggatgacatgaacacatagcattgtctctgtcatactgaaaatgaaacgaccttattaattttaattgatacatatagatatatatattggggagctatgtgtgataatttcatacatttgtataatttgtaaagatc

SEQ ID NO: 335534 - DNA, 616 bp, Homo sapiens
ttctgctccctgaacatcacaactaaaagttccttgtctttgcaaaagagcaaaattacccccattacagtcagatgccgttgggagtgaacagtacaacgctaaatatatgttctcccctgatgcaggatggcattccccatgcttcattccatcattattctatgttccccagattccttcagcatctccataaaagcaataacacctttgccaaacacaagagaaaaaaaagagtagctgcccttgaaatagtaactcaatccaaagaaaagtttattgctggaagaacttttatttaccaaaacttccatactagacttacagcagggagaatacaacaaaaatggtttgtaggaaaaggtaccaggcaacagtgaatagcatggcacagaaaacagcaggacaggatgacagggaggcaggaaactcttaagggagattaaggatcccatagtcccacaatgaccttgtctgaaatagcatatggtcttgcagtccctgattgactatatgctccttgaagacagtcttactcatatgggtattatccacaccatctagtaccacaccataacatggtaggcactcaaatggtcacaaagaagctaaggcc

SEQ ID NO: 335535 - DNA, 349 bp, Homo sapiens
ggggaggatttgcctccagccacggaggaggggtatgctgtggaaggaggccagatctcccccagctgtttcccagctctgtttgaaggggaagggagagggataaatgactgggtgattgtggcacctacagccagcatctttcctctccacattctaggtcacaggcccacacctctctccctagtcaaagagagcctctgtgagggggttgaagggtgtcttggatctgtgggcaggacttgggatctgggcacagagaggttggggaattaacaaaggtcacacagccaggcaaaactagggaatgtggggagtcattctagacaggacctttagggggagctcc

SEQ ID NO: 335536 - DNA, 384 bp, Homo sapiens
agactcagtaagccttggaatttgccaaggactggctaggacctagaactaagatcttataaccacactccatgcaactatgagtctctaaatctctctgtaagaaaaaaatttcaaagtaaagattttactcttgcaatttctgttgtgatagtaccatctctttcacatactacatacaaattccctaataatcaaaagattgtacacatttttttcaatgaagtacaataatgtgaactgcatgtgtaaacagcatcacattattaccacctctctatggtattatagtggcagtatgctttgcctcagccttcactaattaggaatattgtgacaattcattgctaataaaacataacatgagtctctttgtactgtttt

SEQ ID NO: 335537 - DNA, 240 bp, Homo sapiens
ctttcctctttgtttttttcctggaaaggatgaaaatattattatctggacttgtcaaggttgtcctgcgttgttttttttacactttacatggtcacatttcagtgctgttggtaaacagggattcaaatactaggaggagacgtgaaagagagattgagaaaagaccagggaaataatgccaacaaagccagagtcagatttaagcactaagaaggcaagggcaacgcagggactatg

SEQ ID NO: 335538 - DNA, 309 bp, Homo sapiens
tagggtgatagaaacagaaaaagttacaatacaaagtgataaatgctgtaacaggttttacataaggtataataatgacctaaaagagagtgtcatctcctagtgtatgatatggactaggataggagaacttaggaaagaatttgcagaatgaaatggctttttatcttagttttgaaggaggaataagaaatttggtgaatagggacagagaggaatattgcaaatagaagagcatctgcaaaccacagaattgtaaaacatcaaaaaagtatgtttggaaaatactaagtactttggtggtggtgt

SEQ ID NO: 335539 - DNA, 676 bp, Homo sapiens
gacacagagtgagtgaggaaactcagcaaatggggagtctggtgacggtggcaaggtcttcgcactgcgcacaggatgggactccgacccaagggttcggtggcagaccaatgcatgcaccacactgcctccagtctagatgttagcagctctttgatatacctcaattcaatggtggcttttcaagaaaaagaatgcatgctaccacattaagtaaaataattaattgaaagtcatacaacaatcttagaatcttcagtatcaagtaaaaaacagtttatacctccttggggagaaggacacatgaccctgacatccttaagcacttgtattatccagctcactcctcacaggctaactctgtgctcaccaagcagccttccaattatattacccttcggcatctgaattttctacatgaagagaacatgccaatatggaaaggcaggtggtggggcctttgctgatgttaataaactcacattctagtttattccccaggctcttgtgagcacactcagcatgaatgctgctcctagagctcaagtcattttctgtgctctaacaaatccgaacttcttagtccctcaagcaaaggattagacctggaatgcagggccttactggggtgctgccatggtgggaatcttgctgggaatgagtgagctgcgtctgc

SEQ ID NO: 335540 - DNA, 976 bp, Homo sapiens
tgagacccagagtctcgttcagtcgcccaggctggagtgcagtggtgcaatcttggctcactgcaacctccacctcctgggttcaagcagttctcctgcctcagcttccccagtagcagggtgcgtcaccacacccggctaattttttgtatttttagtaaagacgaggttttgccatgttgcctaggctggtcttgaactcctgagctcaggtgatccgcccacctcagcctcccaaagtgcggggattacaggcatgagccaccacacccagtcctttcctggcacatttgcagcttgtcaacacagcggaaatcacgggagaatgttgagcccttccctgggctcagctgcttgctctgttcataagctttaatagcccccggggctctgggccaggtgacccggctttaaatccctgctgtgtgaacttaggcaggtacctcccctctctgggctcttcttttccatcaagcagacagaaaacctcaaccccacaaggttgctgtgagaagaagtgggaagctgctggttccctgggcacaggaagtgcttgttccttgttctggagactcaagacattcccagaatcttcttaagcagagctgctggggagtagcccctgtagcaagtaccatgctcttgacaggcagcatgagagcgtgactcccatgacccacctgtgctcaaaaaaaaaaaaaaaaaaaaagcaaaccaggaaaactgactacacaaacattgtagaaagattagaaaatagaagcagaaagaagactcattggccatcccactctctggggtgaatactgttatattttcttctaggcctttttctatgaatatatagaatatagattttgccaccgtggtatcctactatgcacactgttttcttataatctgcttttgcacttaactgtacattgtgaacctctttccatgtcaacaaatacatgtttatctcatcgctgtacgt

SEQ ID NO: 335541 - DNA, 994 bp, Homo sapiens
tgcctgcaccttaggatcacctggagagctttaaaaatcccatgtctagcctcaccccaggccaataaatcccaatctgagatttttaaaaagttccttccacaattctgttgtgcacctggggtcagaaaaccaccaggttagaccagtgtccagctgggatggaccggggagggtcagacagatcggactgggcacacccctgagtgtcacggcaggagacaaagaagaagaacaggaagagctttggtcactttggcctcctctgagctagtgctctaagtacctcatcttatttagcccccatcttacagatgacgaaactgagggtcagaaaggcccaaggtccatatagcaacaagtgtcagagccaggacacaaacacgggtctgactccacatccattgggctggcctctacttaccagcagccaaatcacagaggggcctggcttgcctgaaacccctcccgcgagtgcactgtcttgtgttttgttttagaaaacctcaaccccacaaggttgctgtgagaagaagtgggaagctgctggttccctgggcacaggaagtgcttgttccttgttctggagactcaagacattcccagaatcttcttaagcagagctgctggggagtagcccctgtagcaagtaccatgctcttgacaggcagcatgagagcgtgactcccatgacccacctgtgctcaaaaaaaaaaaaaaaaaaaaagcaaaccaggaaaactgactacacaaacattgtagaaagattagaaaatagaagcagaaagaagactcattggccatcccactctctggggtgaatactgttatattttcttctaggcctttttctatgaatatatagaatatagattttgccaccgtggtatcctactatgcacactgttttcttataatctgcttttgcacttaactgtacattgtgaacctctttccatgtcaacaaatacatgtttatctcatcgctgtacgt

SEQ ID NO: 335542 - DNA, 974 bp, Homo sapiens
tgagacccagagtctcgttcagtcgcccaggctggagtgcagtggtgcaatcttggctcactgcaacctccacctcctgggttcaagcagttctcctgcctcagcttccccagtagcagggtgcgtcaccacacccggctaattttttgtatttttagtaaagacgaggttttgccatgttgcctaggctggtcttgaactcctgagctcaggtgatccgcccacctcagcctcccaaagtgcggggattacaggcatgagccaccacacccagtcctttcctggcacatttgcagcttgtcaacacagcggaaatcacgggagaatgttgagcccttccctgggctcagctgcttgctctgttcataagctttaatagcccccggggctctgggccaggtgacccggctttaaatccctgctgtgtgaacttaggcaggtacctcccctctctgggctcttcttttccatcaagcagacagaaaacctcaaccccacaaggttgctgtgagaagaagtgggaagctgctggttccctgggcacaggaagtgcttgttccttgttctggagactcaagacattcccagaatcttcttaagcagagctgctggggagtagcccctgtagcaagtaccatgctcttgacaggcagcatgagagcgtgactcccatgacccacctgtgctcaaaaaaaaaaaaaaaaaaaaagcaaaccaggaagtgtgtagcggctgcctggtaagggagtacacagtggaggcaggaagaaggctctgtgcccataggggtctcaggggttaatggagggatattatgttgtggtcggtgccctatggggatatggaatgtgagctttggcaggcgtggtatcaggttatgggcattgtgttgtaatagtttgcttaggttgtgcagggggcagtgtaggcgtctttccagctcatcggtgatatgtttgtgtatggcctgaacc

SEQ ID NO: 335543 - DNA, 460 bp, Homo sapiens
ccccatcttacagatgacgaaactgagggtcagaaaggcccaaggtccatatagcaacaagtgtcagagccaggacacaaacacgggtctgactccacatccattgggctggcctctacttaccagcagccaaatcacagaggggcctggcttgcctgaaacccctcccgcgagtgctcagatggggctcctgcaggcggcaaaggaaggaacagccagcgccaggcactgagccaggcttcgaatatcctctcctttaatcctcacaaccaacccaggaatcattactcccattttatagatgagcaaagtgagtcttcattaaagtgaaataacttgcccaaggtcatctagctcctaaatcgcagagctgagattcaaacccaggcctctcgccacgctgggctcactgcctatgggttagccctgctccacaaggaacagcacaaatatttttgtt

SEQ ID NO: 335544 - DNA, 545 bp, Homo sapiens
gtggatcctagagtatgtgtacttttatgttgggctgctttcactcagcaaaatatttttttttattatttaagttctgggatacgtgtgcagaatgtgcaggtttgctacacaggtatatatgtgccatggtggtttgctgcacccatcaacccgtcacctaggttttaagccccacagaataggtatttgtcctaatgctgtccctccccttgcctcccaactcccaacaggccccggtgtgtgatgttcccctccctatgtccgtgtgttctcattgtttaactcccatttatgagtgagaacatgtggtgtttggttttctgttcctgtgttagtttgagattcatctaagttgttgtgtgtttcagtagttcattcattttgtagctgaggagtattacatggtatggtgtgttttaggctgttgttgcattgctgtaaggaaatacgtgagactcggtaatttagaaagaaaagagccttcattggctcctggttctgcaggctctacaagaagcatggtgctggcgtgcttggcttct

SEQ ID NO: 335545 - DNA, 3939 bp, Homo sapiens
acgttaccaaacggtctcctacaaaggcagaaaccgtttaaatatttcagaaggattgattttcattttgcaaatataatactggttcattttctttctcttcctccatccattctactattgaacataaaacgtgtcaatagtattgtagttcagcatgtatctcaggatattaaaagggcagtgtgactcagctagaaaaggatgaactttccccaaagataaagtgacctatgcgactctgttgggtacaagtgacacagaaagtcatctcaaactagctgaaacacaaaagcgcaggaaggcggaagggaaggcggagaccggcaagagaggggagaaggcccggggaagacgctcgggaccaagatgcggggcccgggtgcgagcagctgaacctctcggcccccaggcgtggtgacctgggtggcgacgctcgtggaggccgaggagcttctggaccggcgcttcgggggaccaagtggagaggctgctggagttgtcgcctgagtcctcccttagttcttcgcgccggcctcgcccacggctccgggtcccagccgccactgcagtctccgcagcaccgagcggggctccaccgactcgcgacctccagcctccgcctcaagggcagggagcgcggctgggtctctggaaagccatttttaaatcactgcctctgctgcccccatgtgaggtcggagtgtcctcccccgtctttgctttcaggttctttcaggttcctttgggcaaacccgcagctaagagtccagcttgtgaacttgaacctgaacttgctgaagaagctcccggcggccccctgctgtctgcggcctttgtttgagggagaggctggggtcacccggttgggccgcatttccggggccgtcacctgtcgggctgccaggccgcgcgtaccttgtcccatcgggggctctgctctgccccctgcgctgatgacgcgggtggaagggaggtatcaggggcactctggggagctgtacctggcgggcaccccccagctgctctccgtggggtacgacaccgagacctggttgggctgcaaggagaccgactgggattcccgggctggtggccggggagacgaaggcggggggtgagaggcaggaacccaggaggccccaggcccagcgctgtggggctgctgttgtcgttctgcgtggaggtctggccaaactggcttttgccccgagtgaggaattcctgctcttttttggttttggtaagaggtcgctattcacagagggggcggggttcgtcccctccaggcgagtacggggctggcgggcgcagtgctgcctttctgctctgtctcttgatcccgcttaggatctttgtggctcctctgagtcttcttagagaggccgtgaaagatgggaaaggcaggttgctgaaacgctgctgctcggggctggcagagaccctggtatagggaaggcgcaccactgtgggtcagatcagctgacagtgggggttttaggtgatggggtaaccttacagttcggatctcttagaacccagaagcaggtaggcgatcgctgcttcatcacacttcacagggagtcctggatctttcctgtccgtaacccatggacgccatgattcagtatggcggaggtccggggcttaagttcctgttcatgcttcctaatcattcatggatccatcacaatgtgctctgaagggcctctcttgctgggattgagaaggatacattttttgagcaggtttttatactcaatggacatgtagaagggaatatattctactcagttcccctcctgcagctccttgaaattctgtccatcaaaagcagggatctgctgaccagaggtgactgccacagaaggtatccagtttgtaaaagctgaatttgttgctgaagccagaatttgcaatcttgatgtttgtgttaacatccaagagcgtgttttctgcctttaaatctctgtggacaatacgtttctggtgacagcttgcacagcagacacttttggtagaatttgcttcagtcctttttttttctttcctgctgccatgagcaggtattcacaaacttctcctcctggctagtgtgcttcatgacaaagcaaagagattcctcaatatcgatcacagcaaatgtttcactatgttggggtgatccgagccttcatggttcctactttgtggatggtgtctggaggagatctgctgagtctcatcaatgaacttcacagctgctgctttcccagttaagaggtcccaggccaaccttaccttagccaggttgcccttgacgatggtctcaaggatcctagctgccagtaagggtcccttctcagcagagatggctgagaggccctgtggcatgtgagacttactgctgggcttggagtcaaggtgtcccaggtcagcttaatttcgggaaaaactggtaagacgcttggttcaaatcacttgaaaagaaaatcacttgcatagttcacctgaagaatggatctctataatggaattaaagcacaatgctggacaaaaagtaagaaaaagcaacaaactgaaaggaaaaattgagtaaaaagaataaagaactagaactggcaacctcagccaagccagggaattacatacatcttggaattccaaagcaatgcttccttatgagggcataggaagaaataaatctaataacaaggctgggattaattcacgtggttttctcacattttggtctcaagaactttttactctaaaactaattattgaggaccccaaagagctttttatgtgggttatagttatcagtatttactttattggaaattaaaacctgtaggatgtttcagtggtcttttctagtttgaagggtttaataatttttggcttttaaagagcccataatcaattaaaatattttattttcctttaaattgtaaatgattggtgtcataatgatgctacaacttaactggcattacaatactatacaaatacgttctattgtataagtcacaataaggtacattattaactctataacatttaggggaagatagctgttatcatattatttaaagttttgcctagtttctttgtagtagacttatcttttccaggagccagagaacccgctatatcagtttcagtatctttaaatgtagagattgcagctgtgtgttgagaaagcacgtttcacttagcatgggatggggacttcgaggtactggatatgtcactggcacctcaggggaggaaaccaagatgcccctatatgattttaaacatggtttattaaagcgtgatacagaaaagtgcacaaattgtccacctacagcttggtgactgttcacaaattgaactcatctaactagcctccagaataagaaacaggcctttacacacccccaccagcctcccaatccccttttcagtcaccttctctgcagtgataaccactattctatattctgacagcatagtttcacttgttttttaacttcacataaatgggatcagacagtattgaatcctttgtgtctgcttccttcactcaatattttcctgagatttttctatattgtttattctaaatgcccattgtacgactgtaacacaatttgtttatccattttactgttcttgggcatttgggtagttctcactgtggatgctaagaagagtgttgctataaacattcaggtcttttggtaagcatatacctggctttctgttggctatttatacctagaaatagagttgctggcttataaggtatgcatatttttagttttagtagacattgcagtttgtaccaattcacccacccaccaatgtgaatatctaatattgcctgcctgtctgtacgtgtgtactggtatagcattgtggttttaatttgcattttccagtgcctaatgaaataaagcaccttttaatatg

SEQ ID NO: 335546 - DNA, 443 bp, Homo sapiens
gataataatagtcgcttcctaaaactgatccgctccttgtttggagactgaaacagtctttgtaagacaatgaaaggtcacaagattagtattctgagaggggcctgaattctgctaaaatgttgctaactttggaggaagccagctgccatgtcacaaaaagattcaggaagccatgtggagaggcccacatcatgaggaactgaggtctttgccaattaccagcaaggaaatgaggcctcctgccaacagccacgtgagtatcctaccttggaaatggaccctctaacttcaatcagccttcaaataactgcagccccagttgatggcttgactgcaaccttaggagaaaccctgagccaaaaacattgaggaaaaacacccccagattcctatcagaaattgtgtaagataataaatgtttgttgttttaagctgctaaa

SEQ ID NO: 335547 - DNA, 424 bp, Homo sapiens
ggctctgcacccttccggccgctaagacaaggcctcagacacggggttctgccctgtctactgtcagcagagccaagctgagaaggatgggcacgagaaaaggttgctaactttggaggaagccagctgccatgtcacaaaaagattcaggaagccatgtggagaggcccacatcatgaggaactgaggtctttgccaattaccagcaaggaaatgaggcctcctgccaacagccacgtgagtatcctaccttggaaatggaccctctaacttcaatcagccttcaaataactgcagccccagttgatggcttgactgcaaccttaggagaaaccctgagccaaaaacattgaggaaaaacacccccagattcctatcagaaattgtgtaagataataaatgtttgttgttttaagctgctaaa

SEQ ID NO: 335548 - DNA, 3873 bp, Homo sapiens
tagttgtagcagggttagttgcaccttaggttgaagcaagattttgctactggaaattaaatatggtaaaaggaggtgctctcggccgccaatttgacaagggatggaccgtgctggttttgtatcaactggcctaagctagaacttcatttccattatgtctccatatcagactctgttgggtacaagtgacacagaaagtcatctcaaactagctgaaacacaaaagcgcaggaaggcggaagggaaggcggagaccggcaagagaggggagaaggcccggggaagacgctcgggaccaagatgcggggcccgggtgcgagcagctgaacctctcggcccccaggcgtggtgacctgggtggcgacgctcgtggaggccgaggagcttctggaccggcgcttcgggggaccaagtggagaggctgctggagttgtcgcctgagtcctcccttagttcttcgcgccggcctcgcccacggctccgggtcccagccgccactgcagtctccgcagcaccgagcggggctccaccgactcgcgacctccagcctccgcctcaagggcagggagcgcggctgggtctctggaaagccatttttaaatcactgcctctgctgcccccatgtgaggtcggagtgtcctcccccgtctttgctttcaggttctttcaggttcctttgggcaaacccgcagctaagagtccagcttgtgaacttgaacctgaacttgctgaagaagctcccggcggccccctgctgtctgcggcctttgtttgagggagaggctggggtcacccggttgggccgcatttccggggccgtcacctgtcgggctgccaggccgcgcgtaccttgtcccatcgggggctctgctctgccccctgcgctgatgacgcgggtggaagggaggtatcaggggcactctggggagctgtacctggcgggcaccccccagctgctctccgtggggtacgacaccgagacctggttgggctgcaaggagaccgactgggattcccgggctggtggccggggagacgaaggcggggggtgagaggcaggaacccaggaggccccaggcccagcgctgtggggctgctgttgtcgttctgcgtggaggtctggccaaactggcttttgccccgagtgaggaattcctgctcttttttggttttggtaagaggtcgctattcacagagggggcggggttcgtcccctccaggcgagtacggggctggcgggcgcagtgctgcctttctgctctgtctcttgatcccgcttaggatctttgtggctcctctgagtcttcttagagaggccgtgaaagatgggaaaggcaggttgctgaaacgctgctgctcggggctggcagagaccctggtatagggaaggcgcaccactgtgggtcagatcagctgacagtgggggttttaggtgatggggtaaccttacagttcggatctcttagaacccagaagcaggtaggcgatcgctgcttcatcacacttcacagggagtcctggatctttcctgtccgtaacccatggacgccatgattcagtatggcggaggtccggggcttaagttcctgttcatgcttcctaatcattcatggatccatcacaatgtgctctgaagggcctctcttgctgggattgagaaggatacattttttgagcaggtttttatactcaatggacatgtagaagggaatatattctactcagttcccctcctgcagctccttgaaattctgtccatcaaaagcagggatctgctgaccagaggtgactgccacagaaggtatccagtttgtaaaagctgaatttgttgctgaagccagaatttgcaatcttgatgtttgtgttaacatccaagagcgtgttttctgcctttaaatctctgtggacaatacgtttctggtgacagcttgcacagcagacacttttggtagaatttgcttcagtcctttttttttctttcctgctgccatgagcaggtattcacaaacttctcctcctggctagtgtgcttcatgacaaagcaaagagattcctcaatatcgatcacagcaaatgtttcactatgttggggtgatccgagccttcatggttcctactttgtggatggtgtctggaggagatctgctgagtctcatcaatgaacttcacagctgctgctttcccagttaagaggtcccaggccaaccttaccttagccaggttgcccttgacgatggtctcaaggatcctagctgccagtaagggtcccttctcagcagagatggctgagaggccctgtggcatgtgagacttactgctgggcttggagtcaaggtgtcccaggtcagcttaatttcgggaaaaactggtaagacgcttggttcaaatcacttgaaaagaaaatcacttgcatagttcacctgaagaatggatctctataatggaattaaagcacaatgctggacaaaaagtaagaaaaagcaacaaactgaaaggaaaaattgagtaaaaagaataaagaactagaactggcaacctcagccaagccagggaattacatacatcttggaattccaaagcaatgcttccttatgagggcataggaagaaataaatctaataacaaggctgggattaattcacgtggttttctcacattttggtctcaagaactttttactctaaaactaattattgaggaccccaaagagctttttatgtgggttatagttatcagtatttactttattggaaattaaaacctgtaggatgtttcagtggtcttttctagtttgaagggtttaataatttttggcttttaaagagcccataatcaattaaaatattttattttcctttaaattgtaaatgattggtgtcataatgatgctacaacttaactggcattacaatactatacaaatacgttctattgtataagtcacaataaggtacattattaactctataacatttaggggaagatagctgttatcatattatttaaagttttgcctagtttctttgtagtagacttatcttttccaggagccagagaacccgctatatcagtttcagtatctttaaatgtagagattgcagctgtgtgttgagaaagcacgtttcacttagcatgggatggggacttcgaggtactggatatgtcactggcacctcaggggaggaaaccaagatgcccctatatgattttaaacatggtttattaaagcgtgatacagaaaagtgcacaaattgtccacctacagcttggtgactgttcacaaattgaactcatctaactagcctccagaataagaaacaggcctttacacacccccaccagcctcccaatccccttttcagtcaccttctctgcagtgataaccactattctatattctgacagcatagtttcacttgttttttaacttcacataaatgggatcagacagtattgaatcctttgtgtctgcttccttcactcaatattttcctgagatttttctatattgtttattctaaatgcccattgtacgactgtaacacaatttgtttatccattttactgttcttgggcatttgggtagttctcactgtggatgctaagaagagtgttgctataaacattcaggtcttttggtaagcatatacctggctttctgttggctatttatacctagaaatagagttgctggcttataaggtatgcatatttttagttttagtagacattgcagtttgtaccaattcacccacccaccaatgtgaatatctaatattgcctgcctgtctgtacgtgtgtactggtatagcattgtggttttaatttgcattttccagtgcctaatgaaataaagcaccttttaatatg

SEQ ID NO: 335549 - DNA, 4274 bp, Homo sapiens
acgttaccaaacggtctcctacaaaggcagaaaccgtttaaatatttcagaaggattgattttcattttgcaaatataatactggttcattttctttctcttcctccatccattctactattgaacataaaacgtgtcaatagtattgtagttcagcatgtatctcaggatattaaaagggcagtgtgactcagctagaaaaggatgaactttccccaaagataaagtgacctatgcggtttggccaaaagatatatctatgccagatttgggaagcagaagtgaaagagtaaccgttactctgtgtagctggtgcggaaggagagaagtgtagatgtactgcttgtgggctctagcttgtcctcgcctgcctctgtcttgactccagctggtgtccttttctgcctgccttgctgaccaacagcagccccaaacccacagtcaatgcagaggcaacagccttccatgcacttcttcgccagctcctgttgtggtctcactcttgcaactggatgttcccagttctctatatgtaacctgtgacttttccttcacttgactacttcaggagagactctgttgggtacaagtgacacagaaagtcatctcaaactagctgaaacacaaaagcgcaggaaggcggaagggaaggcggagaccggcaagagaggggagaaggcccggggaagacgctcgggaccaagatgcggggcccgggtgcgagcagctgaacctctcggcccccaggcgtggtgacctgggtggcgacgctcgtggaggccgaggagcttctggaccggcgcttcgggggaccaagtggagaggctgctggagttgtcgcctgagtcctcccttagttcttcgcgccggcctcgcccacggctccgggtcccagccgccactgcagtctccgcagcaccgagcggggctccaccgactcgcgacctccagcctccgcctcaagggcagggagcgcggctgggtctctggaaagccatttttaaatcactgcctctgctgcccccatgtgaggtcggagtgtcctcccccgtctttgctttcaggttctttcaggttcctttgggcaaacccgcagctaagagtccagcttgtgaacttgaacctgaacttgctgaagaagctcccggcggccccctgctgtctgcggcctttgtttgagggagaggctggggtcacccggttgggccgcatttccggggccgtcacctgtcgggctgccaggccgcgcgtaccttgtcccatcgggggctctgctctgccccctgcgctgatgacgcgggtggaagggaggtatcaggggcactctggggagctgtacctggcgggcaccccccagctgctctccgtggggtacgacaccgagacctggttgggctgcaaggagaccgactgggattcccgggctggtggccggggagacgaaggcggggggtgagaggcaggaacccaggaggccccaggcccagcgctgtggggctgctgttgtcgttctgcgtggaggtctggccaaactggcttttgccccgagtgaggaattcctgctcttttttggttttggtaagaggtcgctattcacagagggggcggggttcgtcccctccaggcgagtacggggctggcgggcgcagtgctgcctttctgctctgtctcttgatcccgcttaggatctttgtggctcctctgagtcttcttagagaggccgtgaaagatgggaaaggcaggttgctgaaacgctgctgctcggggctggcagagaccctggtatagggaaggcgcaccactgtgggtcagatcagctgacagtgggggttttaggtgatggggtaaccttacagttcggatctcttagaacccagaagcaggtaggcgatcgctgcttcatcacacttcacagggagtcctggatctttcctgtccgtaacccatggacgccatgattcagtatggcggaggtccggggcttaagttcctgttcatgcttcctaatcattcatggatccatcacaatgtgctctgaagggcctctcttgctgggattgagaaggatacattttttgagcaggtttttatactcaatggacatgtagaagggaatatattctactcagttcccctcctgcagctccttgaaattctgtccatcaaaagcagggatctgctgaccagaggtgactgccacagaaggtatccagtttgtaaaagctgaatttgttgctgaagccagaatttgcaatcttgatgtttgtgttaacatccaagagcgtgttttctgcctttaaatctctgtggacaatacgtttctggtgacagcttgcacagcagacacttttggtagaatttgcttcagtcctttttttttctttcctgctgccatgagcaggtattcacaaacttctcctcctggctagtgtgcttcatgacaaagcaaagagattcctcaatatcgatcacagcaaatgtttcactatgttggggtgatccgagccttcatggttcctactttgtggatggtgtctggaggagatctgctgagtctcatcaatgaacttcacagctgctgctttcccagttaagaggtcccaggccaaccttaccttagccaggttgcccttgacgatggtctcaaggatcctagctgccagtaagggtcccttctcagcagagatggctgagaggccctgtggcatgtgagacttactgctgggcttggagtcaaggtgtcccaggtcagcttaatttcgggaaaaactggtaagacgcttggttcaaatcacttgaaaagaaaatcacttgcatagttcacctgaagaatggatctctataatggaattaaagcacaatgctggacaaaaagtaagaaaaagcaacaaactgaaaggaaaaattgagtaaaaagaataaagaactagaactggcaacctcagccaagccagggaattacatacatcttggaattccaaagcaatgcttccttatgagggcataggaagaaataaatctaataacaaggctgggattaattcacgtggttttctcacattttggtctcaagaactttttactctaaaactaattattgaggaccccaaagagctttttatgtgggttatagttatcagtatttactttattggaaattaaaacctgtaggatgtttcagtggtcttttctagtttgaagggtttaataatttttggcttttaaagagcccataatcaattaaaatattttattttcctttaaattgtaaatgattggtgtcataatgatgctacaacttaactggcattacaatactatacaaatacgttctattgtataagtcacaataaggtacattattaactctataacatttaggggaagatagctgttatcatattatttaaagttttgcctagtttctttgtagtagacttatcttttccaggagccagagaacccgctatatcagtttcagtatctttaaatgtagagattgcagctgtgtgttgagaaagcacgtttcacttagcatgggatggggacttcgaggtactggatatgtcactggcacctcaggggaggaaaccaagatgcccctatatgattttaaacatggtttattaaagcgtgatacagaaaagtgcacaaattgtccacctacagcttggtgactgttcacaaattgaactcatctaactagcctccagaataagaaacaggcctttacacacccccaccagcctcccaatccccttttcagtcaccttctctgcagtgataaccactattctatattctgacagcatagtttcacttgttttttaacttcacataaatgggatcagacagtattgaatcctttgtgtctgcttccttcactcaatattttcctgagatttttctatattgtttattctaaatgcccattgtacgactgtaacacaatttgtttatccattttactgttcttgggcatttgggtagttctcactgtggatgctaagaagagtgttgctataaacattcaggtcttttggtaagcatatacctggctttctgttggctatttatacctagaaatagagttgctggcttataaggtatgcatatttttagttttagtagacattgcagtttgtaccaattcacccacccaccaatgtgaatatctaatattgcctgcctgtctgtacgtgtgtactggtatagcattgtggttttaatttgcattttccagtgcctaatgaaataaagcaccttttaatatg

SEQ ID NO: 335550 - DNA, 3838 bp, Homo sapiens
acgttaccaaacggtctcctacaaaggcagaaaccgtttaaatatttcagaaggattgattttcattttgcaaatataatactggttcattttctttctcttcctccatccattctactattgaacataaaacgtgtcaatagtattgtagttcagcatgtatctcaggatattaaaagggcagtgtgactcagctagaaaaggatgaactttccccaaagataaagtgacctatgcgactctgttgggtacaagtgacacagaaagtcatctcaaactagctgaaacacaaaagcgcaggaaggcggaagggaaggcggagaccggcaagagaggggagaaggccgaggagcttctggaccggcgcttcgggggaccaagtggagaggctgctggagttgtcgcctgagtcctcccttagttcttcgcgccggcctcgcccacggctccgggtcccagccgccactgcagtctccgcagcaccgagcggggctccaccgactcgcgacctccagcctccgcctcaagggcagggagcgcggctgggtctctggaaagccatttttaaatcactgcctctgctgcccccatgtgaggtcggagtgtcctcccccgtctttgctttcaggttctttcaggttcctttgggcaaacccgcagctaagagtccagcttgtgaacttgaacctgaacttgctgaagaagctcccggcggccccctgctgtctgcggcctttgtttgagggagaggctggggtcacccggttgggccgcatttccggggccgtcacctgtcgggctgccaggccgcgcgtaccttgtcccatcgggggctctgctctgccccctgcgctgatgacgcgggtggaagggaggtatcaggggcactctggggagctgtacctggcgggcaccccccagctgctctccgtggggtacgacaccgagacctggttgggctgcaaggagaccgactgggattcccgggctggtggccggggagacgaaggcggggggtgagaggcaggaacccaggaggccccaggcccagcgctgtggggctgctgttgtcgttctgcgtggaggtctggccaaactggcttttgccccgagtgaggaattcctgctcttttttggttttggtaagaggtcgctattcacagagggggcggggttcgtcccctccaggcgagtacggggctggcgggcgcagtgctgcctttctgctctgtctcttgatcccgcttaggatctttgtggctcctctgagtcttcttagagaggccgtgaaagatgggaaaggcaggttgctgaaacgctgctgctcggggctggcagagaccctggtatagggaaggcgcaccactgtgggtcagatcagctgacagtgggggttttaggtgatggggtaaccttacagttcggatctcttagaacccagaagcaggtaggcgatcgctgcttcatcacacttcacagggagtcctggatctttcctgtccgtaacccatggacgccatgattcagtatggcggaggtccggggcttaagttcctgttcatgcttcctaatcattcatggatccatcacaatgtgctctgaagggcctctcttgctgggattgagaaggatacattttttgagcaggtttttatactcaatggacatgtagaagggaatatattctactcagttcccctcctgcagctccttgaaattctgtccatcaaaagcagggatctgctgaccagaggtgactgccacagaaggtatccagtttgtaaaagctgaatttgttgctgaagccagaatttgcaatcttgatgtttgtgttaacatccaagagcgtgttttctgcctttaaatctctgtggacaatacgtttctggtgacagcttgcacagcagacacttttggtagaatttgcttcagtcctttttttttctttcctgctgccatgagcaggtattcacaaacttctcctcctggctagtgtgcttcatgacaaagcaaagagattcctcaatatcgatcacagcaaatgtttcactatgttggggtgatccgagccttcatggttcctactttgtggatggtgtctggaggagatctgctgagtctcatcaatgaacttcacagctgctgctttcccagttaagaggtcccaggccaaccttaccttagccaggttgcccttgacgatggtctcaaggatcctagctgccagtaagggtcccttctcagcagagatggctgagaggccctgtggcatgtgagacttactgctgggcttggagtcaaggtgtcccaggtcagcttaatttcgggaaaaactggtaagacgcttggttcaaatcacttgaaaagaaaatcacttgcatagttcacctgaagaatggatctctataatggaattaaagcacaatgctggacaaaaagtaagaaaaagcaacaaactgaaaggaaaaattgagtaaaaagaataaagaactagaactggcaacctcagccaagccagggaattacatacatcttggaattccaaagcaatgcttccttatgagggcataggaagaaataaatctaataacaaggctgggattaattcacgtggttttctcacattttggtctcaagaactttttactctaaaactaattattgaggaccccaaagagctttttatgtgggttatagttatcagtatttactttattggaaattaaaacctgtaggatgtttcagtggtcttttctagtttgaagggtttaataatttttggcttttaaagagcccataatcaattaaaatattttattttcctttaaattgtaaatgattggtgtcataatgatgctacaacttaactggcattacaatactatacaaatacgttctattgtataagtcacaataaggtacattattaactctataacatttaggggaagatagctgttatcatattatttaaagttttgcctagtttctttgtagtagacttatcttttccaggagccagagaacccgctatatcagtttcagtatctttaaatgtagagattgcagctgtgtgttgagaaagcacgtttcacttagcatgggatggggacttcgaggtactggatatgtcactggcacctcaggggaggaaaccaagatgcccctatatgattttaaacatggtttattaaagcgtgatacagaaaagtgcacaaattgtccacctacagcttggtgactgttcacaaattgaactcatctaactagcctccagaataagaaacaggcctttacacacccccaccagcctcccaatccccttttcagtcaccttctctgcagtgataaccactattctatattctgacagcatagtttcacttgttttttaacttcacataaatgggatcagacagtattgaatcctttgtgtctgcttccttcactcaatattttcctgagatttttctatattgtttattctaaatgcccattgtacgactgtaacacaatttgtttatccattttactgttcttgggcatttgggtagttctcactgtggatgctaagaagagtgttgctataaacattcaggtcttttggtaagcatatacctggctttctgttggctatttatacctagaaatagagttgctggcttataaggtatgcatatttttagttttagtagacattgcagtttgtaccaattcacccacccaccaatgtgaatatctaatattgcctgcctgtctgtacgtgtgtactggtatagcattgtggttttaatttgcattttccagtgcctaatgaaataaagcaccttttaatatg

SEQ ID NO: 335551 - DNA, 1095 bp, Homo sapiens
gtcacagaaggtcattcaattatcaatggttcttccccagctactcaacaagagaatgagaacctctgatcactcacttcagtgcctatgccatcaggtcctaaataatgatgctacaacttaactggcattacaatactatacaaatacgttctattgtataagtcacaataaggtacattattaactctataacatttaggggaagatagctgttatcatattatttaaagttttgcctagtttctttgtagtagacttatcttttccaggagccagagaacccgctatatcagtttcagtatctttaaatgtagagattgcagctgtgtgttgagaaagcacgtttcacttagcatgggatggggacttcgaggtactggatatgtcactggcacctcaggggaggaaaccaagatgcccctatatgattttaaacatggtttattaaagcgtgatacagaaaagtgcacaaattgtccacctacagcttggtgactgttcacaaattgaactcatctaactagcctccagaataagaaacaggcctttacacacccccaccagcctcccaatccccttttcagtcaccttctctgcagtgataaccactattctatattctgacagcatagtttcacttgttttttaacttcacataaatgggatcagacagtattgaatcctttgtgtctgcttccttcactcaatattttcctgagatttttctatattgtttattctaaatgcccattgtacgactgtaacacaatttgtttatccattttactgttcttgggcatttgggtagttctcactgtggatgctaagaagagtgttgctataaacattcaggtcttttggtaagcatatacctggctttctgttggctatttatacctagaaatagagttgctggcttataaggtatgcatatttttagttttagtagacattgcagtttgtaccaattcacccacccaccaatgtgaatatctaatattgcctgcctgtctgtacgtgtgtactggtatagcattgtggttttaatttgcattttccagtgcctaatgaaataaagcaccttttaatatg

SEQ ID NO: 335552 - DNA, 1499 bp, Homo sapiens
tagttgtagcagggttagttgcaccttaggttgaagcaagattttgctactggaaattaaatatggtaaaaggaggtgctctcggccgccaatttgacaagggatggaccgtgctggttttgtatcaactggcctaagctagaacttcatttccattatgtctccatatcagactctgttgggtacaagtgacacagaaagtcatctcaaactagctgaaacacaaaagcgcaggaaggcggaagggaaggcggagaccggcaagagaggggagaaggcccggggaagacgctcgggaccaagatgcggggcccgggtgcgagcagctgaacctctcggcccccaggcgtggtgacctgggtggcgacgctcgtggaggccgaggagcttctggaccggcgcttcgggggaccaagtggagaggctgctggagttgtcgcctgagtcctcccttagttcttcgcgccggcctcgcccacggctccgggtcccagccgccactgcagtctccgcagcaccgagcggggctccaccgactcgcgacctccagcctccgcctcaagggcagggagcgcggctgggtctctggaaagccatttttaaatcactgcctctgctgcccccatgtgaggtcggagtgtcctcccccgtctttgctttcaggttctttcaggttcctttgggcaaacccgcagctaagagtccagcttgtgaacttgaacctgaacttgctgaagaagctcccggcggccccctgctgtctgcggcctttgtttgagggagaggctggggtcacccggttgggccgcatttccggggccgtcacctgtcgggctgccaggccgcgcgtaccttgtcccatcgggggctctgctctgccccctgcgctgatgacgcgggtggaagggaggtatcaggggcactctggggagctgtacctggcgggcaccccccagctgctctccgtggggtacgacaccgagacctggttgggctgcaaggagaccgactgggattcccgggctggtggccggggagacgaaggcggggggtgagaggcaggaacccaggaggccccaggcccagcgctgtggggctgctgttgtcgttctgcgtggaggtctggccaaactggcttttgccccgagtgaggaattcctgctcttttttggttttggttgctaactttggaggaagccagctgccatgtcacaaaaagattcaggaagccatgtggagaggcccacatcatgaggaactgaggtctttgccaattaccagcaaggaaatgaggcctcctgccaacagccacgtgagtatcctaccttggaaatggaccctctaacttcaatcagccttcaaataactgcagccccagttgatggcttgactgcaaccttaggagaaaccctgagccaaaaacattgaggaaaaacacccccagattcctatcagaaattgtgtaagataataaatgtttgttgttttaagctgctaaa

SEQ ID NO: 335553 - DNA, 134 bp, Homo sapiens
gggagctgctctgggaaaatgggagttatttttttcagtggacttagtagccttggaagggacctgcagtgagagaggaaggtccttttgcccagccagacacatgagtgggggcatcatcacatctttgtgtc

SEQ ID NO: 335554 - DNA, 134 bp, Homo sapiens
acgctcgctctctctctctctctctctctctcactcactctctttgcccagaattggtatgtcctaggaaaaggccttgttttaagagtgcttgattttctgcccttttactggttcaccccttcctcttcatc

SEQ ID NO: 335555 - DNA, 347 bp, Homo sapiens
atctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacc

SEQ ID NO: 335556 - DNA, 550 bp, Homo sapiens
aatcagctgggcatagtggcatgggcctgtagtcgcagctcctcaagaggctgaggtgagaggatcacttgagtgcaagagttcaaggctgcagtgagctatgatcatgccactatactgtagcctaggtgacagagtgaaatcccctctcaaattgattaattcattaattaatttaaaaaatcaggccaggaaggaaactcagacatttgaaaaaagcttctaacataacagactagagtaaaaacagacaagaggaactaagagaaagaaaacagtgtgagagaacaagacaaaatcttcaaaagttataataaagatcattaaagagattaggagaaaataatgcatccataatacaagaataggaagctataagaaagaacattttgggaaaattaaaaatttagtagaagtgttagaaaaccaatcagaaatattctcccataaagctaaatttaataaacgaagagacgagagagagagagagagagaaaggaaaaaaggttaaaccaggaggtctagcaaccacctaacaggaatcccagga

SEQ ID NO: 335557 - DNA, 356 bp, Homo sapiens
agaccatttgggggctatagcacagcccaggcaaaaatgtcaagagcttaagcagggaggtggccaagagggagagccactgtgaacacagaatccgacaggcttggtgaaggagtgggcagagtcagacagggtttcctgctaggtggctgggaagatgacagtggtgatgctcttacagaatcaggaccctgggaagaggaccagcctgggatgggggccttcttcagcttggggcatatggcatggcccagtgcagacccttgtatgtccctcactgctgttccttctcttcagctccaacaagccccatagagcaccctgcaccagtcaggcactcagtgaatacctctgag

SEQ ID NO: 335558 - DNA, 326 bp, Homo sapiens
ttgaattagtcagcaccactaactcattccaaagcaaggaccacctttattttctcatgtttaaggccagggctgaccactctcccttctctggacccagccactatgcctctctaacccaactcgttctctgcttttgtggttttagtctttaaaagaacttggcttgggaaagagcaataatgatccgaagctaaccacttagctcattagtatgtcatctagacaggcaaaatcaattccaacagcatcgagtttgggtattccctccccaaaaggtctgcgctattaatagcaagaaagtttcccaggctttggtttatttg

SEQ ID NO: 335559 - DNA, 248 bp, Homo sapiens
tactaccccaccattccctcccagttcattctccacattgcagtcagaatcaccttttaagaaaagcacacttgcttgttctttttgtaaaaatcttttattgcccttaaaatgaagcacagacattacagtggccaactcctatgtctttctacttttccacccctccgctttgctctttcattgaagatgttctttgaggtaagagttctgacttatcttgggtacctcacacatgctttttcttt

SEQ ID NO: 335560 - DNA, 322 bp, Homo sapiens
gattgcttgagctcaggagttcaaggctgcagtgagctgtgtatggcaccactgcactccagcctgggtgacggagtgagaccctgtctaaaaaaaaaggacagtgacataagcaaaggtatagggttttcaaagtctgtgttttcttaggtaaaggtgaatggtctgaatggtctggatggtttgagcacagagtgtgtgatggggaagagatgaggccaaaaagttaagtcaggaccaggttatgaatagccttgaagtccacgctgaggcaatgggaacttgattcgataaaacctggggacttcaggggtggggggca

SEQ ID NO: 335561 - DNA, 170 bp, Homo sapiens
attttctttaggaagtcacccttccctactcttggtccctatggtcttcatggttgcaccacctgcatctacagatgaaatcatgtgatcaagggaactgccacatttttgcacccacaacaattggttcatagacggggacatcacccagtcagatcctatgaaacacc

SEQ ID NO: 335562 - DNA, 483 bp, Homo sapiens
tctataaggcttaccctgaactcctaaatcctttaagtgttgaggaatgtgagaaatgtgtatgattttaagtatttgtctgaacttcataaattagggaaattacgtagtgacacggaaagccagatatacatgtgtgacttgtggattatccatgtaattgtttccttaaatcggtgcatacaaaaataagagtcagattttgaatgggcagaaacacacaaaaaacctgtattgcacctgttgttgggaagatttggctggttacaataaggctagatgggctagatgaggatacacaacaatggctcaccccaatttggggaagtcctttttggcctttatgcaatggtcttggggtctggaacccatttcctgctaggcaactgactcatcctgtgacttagggaagcaagccattgcccatctctgggtttcagtttccagagggtgttagattggaaggtttcttccagatttgaa

SEQ ID NO: 335563 - DNA, 220 bp, Homo sapiens
tagctgcaagcctcttagaggactgggtggtgtacctggtgctgctggcaacaccctgcaaatacttctgctccttccccctggagtggtgcaggggaaaggaattcgggaaaagttgatggaacaagggatgggggataggggaagaagaagagggggctcctggagataaacagactcaggcagggagagcagtttattctgtaaagtccctccctca

SEQ ID NO: 335564 - DNA, 791 bp, Homo sapiens
  misc_feature (28)..(28): n is a, c, g, or t
ctagttgccaggtgcccaagaacctggnaagcccaccccttgcatcatcgtgccctggatactcataggcagaaggaacttgccttgtctgaaatgagactttggacttggacttttgtgttaatgctggaatgagtcgagactttggggagctgttgggaaggcatgattgcattttgaaataaaggaatggaatctgagctaacctaccatgtttgtactggaagtcctgccaacagcatttaaggaggcctgcctctcctgcagtcaggtgtgaccaaaggagtatgagtgaaagtaatgtgtgcctctacaaaacctgacgcatatgaagaaacaaaccatccatccacacctgatccttgtcttctccatctgccagctgaatggagagaaacaaagaactcctgctgacccacactggactatgacatgagcaagaagcacacttttattatgttaagccactaatattttgggattatttgttagagcaatggaatctatcatgatgaatacattttttaacattctcatatcttttctttttttttggctaaaattgatccatattctgcgtacttgcttttgtcactgaacatcatgtaaatttttccaaatctattagtatagaggctactcattctttttaataggggtgtaataatcctatatgtattgcagtatatatttaatatgttattatattcaataattatgacagatgagtatttctttgtttttagattcttacttctataaatgatgctgcaataaatattcttatacat

SEQ ID NO: 335565 - DNA, 615 bp, Homo sapiens
catgacaaaatgtctggcttgttagctacctgcatggcagggctggatcttctgtcacctgcatatcatgctgccaggctcgggcgagggtgggggctaacactggagagtgactgagattactgagctcttttactaatacctgatgctgctgactagtcactgcatgaatccacactgggctcttagacttatacatctgacagatctttggctatactcaaagaactcctgctgacccacactggactatgacatgagcaagaagcacacttttattatgttaagccactaatattttgggattatttgttagagcaatggaatctatcatgatgaatacattttttaacattctcatatcttttctttttttttggctaaaattgatccatattctgcgtacttgcttttgtcactgaacatcatgtaaatttttccaaatctattagtatagaggctactcattctttttaataggggtgtaataatcctatatgtattgcagtatatatttaatatgttattatattcaataattatgacagatgagtatttctttgtttttagattcttacttctataaatgatgctgcaataaatattcttatacat

SEQ ID NO: 335566 - DNA, 111 bp, Homo sapiens
ccatcctcaaattcatatgttgaaactctaactcctaatgtgatagcatgtggagatggggcctttgggaggtaggcagggttagatgaggtcataagggtagggtcccca

SEQ ID NO: 335567 - DNA, 338 bp, Homo sapiens
catgaggaacaggaaactccctctggcttccagaaaggaaaactaagaggggaatgaggcacagaggccgaggcaggaaggcgtgaaaagatggaacaggcgattccggagcttagtagtaggtgagtaggtgagatgatccaactcccttgggaaaactgctggcattcaggttccaggcaagaactaggccaggggagactgggtgcggtggctcacgcctgtaatcccagcactttgggaggccgaggcaggtggatcactcgaggacaggagttcgagaccagcctgggcaacatggtgaaaccccatctctactaaaaatacaaaaattagcc

SEQ ID NO: 335568 - DNA, 662 bp, Homo sapiens
ggattaaacacaaaccgtccactgtccagttagtgtccagatagtttagaatgctctagaactgcccagatatatcccctgctcttgacctgaagtagcatttagttaccaagccacagcccactccacacagggcttggagcgaaggactgaagccagggagtgctctggcccttctgagggctgcactgcagcctgccttctctcccttgctcattgcgctgacaagggtgcctaggcccgggaaggatggctcagccagcggggtacagacttccttcctgggaagtcatttctgtaccagctcccctaaatgttgtcttgtgtgtcttttcccgcactaggcattcagtcttgactcttggattacttttgcccctgaatgtcctttggatgtcctcaacaaataaggacaaatatttattgtcatgcagtatttgtttatacgcttcatgtcatttacttcctacaaaagccaaagaggctgttactattattcctatttatacatcaggaaaatgaagctaatgaactcccaaatctaatagcaagtaagtgacatgaagctgggacagcagggaaaagcctaaagtgacaggacaaacccagttgttcactttctgcaccacatttacccaccgcaattccgtatttgttccggg

SEQ ID NO: 335569 - DNA, 105 bp, Homo sapiens
catgtataaaaggtcaaccaagcctgattcttttaacaacaggtgaagtggtatttgacccccttcaagtgcagggttttcctttcaaattaagtttagtcacca

SEQ ID NO: 335570 - DNA, 352 bp, Homo sapiens
catgcccagccatatcacttctttttctactccagcctttactcctattccaatcatttattgtcagcttcacttcctctacagtctcttaatcttttggggactcctcagcagtttgtgaatatgtctgcatttatcctggtgacactggatcttctttagcaactgcctcctctcttcctttcattttacagtcaagtttcttgaaataataatttatccttggaattgtgtgaattcatacttctcattcactttccaagctatgattatcagcttctttcttcctaaactgcttaggcaaagagcacacatggacactttcctaaaccttagtccattgggcattttg

SEQ ID NO: 335571 - DNA, 452 bp, Homo sapiens
ccacttaggaaaaagtgacagctggctggccctaagggaaggacgtgttctgcatcaaaatatgtcccacatggctgtgtggagcatgtggatatgtcccataggtgtgttcaagtgtgactcaacactcaagtgtggagtgttgtttgcccaagtagtctttaggagtgtgtatctcaggtataggagtgcatgtcctgggtaacagtatatctgagagtgcatctcagcatgccccatatgtatgtgggtgcacaattgtgccttatatgcatccatgtgcattcacacatgcagatgcgtacaagtatccctcatgtgtgttcctgtgtgtgtatcctgcctgtgctgagaatgtgcaagtgtgaatattcctcccatgtttaactgaatgtgtgttccaagtgtgttaatgtgaaaatatgttccagctgtgtgtcccatgtgtgtcc

SEQ ID NO: 335572 - DNA, 715 bp, Homo sapiens
gggatggctggctgtcccttttccacggagtggcgcttgtactctgtcccagtcagttaaacacatttgcatgggtctgtttctggttccctggtctgtcccattggtctccatgcccatgcccaccaatcccacactgttggtcactggagatgtctgagaaggctggacattggggatacgtattccttccccctcaatcttctttttcaaggttgttttagctattctagagcctgtgccttcccatataagttttagaattagctcatttatatctataaaaatccttgctgggattttgatagggattttactaaacccaaaggtccatttgggaagagtaaccctctgattttaaagtctcacaaattcgcagtgtgctgtgaccatcgtgtagtgggacagagacctctgtttgcagtgtagacagaagcaggtgacgccctgatcctggcatgcctcccgagtggcagtgagactggctggagccctgcagtgactcactcaagggttctgatgatcgtttccccttcagacatgcagcccagatctgcaatggcttcctcacccttcagacacacagtccagatctgcgatggcttcctcacccttcagacacacagtccaggccactgagatgccttcctcacccttcagacacacagtccagatctgcgataccttccacacccttcagacacacagtccagat

SEQ ID NO: 335573 - DNA, 173 bp, Homo sapiens
ggtagtgaaagagaaaaacattgagtagttacatgagatgatgtcacattatcagtctgaagagttatgaagaatgtacatggttctttaagagtataggtaaaggggggtttcacccagtcttgtgttaggaaggcttccctgaggaggtgatgcataagccgagatctgaa

SEQ ID NO: 335574 - DNA, 418 bp, Homo sapiens
gtggaggttgcagtgagccaagattgcgccactgcactccagcctcggcaacagagcaagactctgtctcaaaaataaataaacaaataaataaggcaccctgggcattaagccacctctgttctgtgattgcatacctccttgggatcggcttgtgacaggcacaaggccaggtgctggggcttagccaggtagatgagcctctttcttcatgtgactcacagtcaaatgggaatagacatcaagtaatcagagcaattttttaaagttttaaaataaatcacagaaaagtaaatgtgatgaggaaagttttaaaataaatcacagaaaagtaaatgtggtgatgaggaaatacagactgttcagtctgggtggtttagggaaagcctttctaagtaacatgatgtttacattaaaa

SEQ ID NO: 335575 - DNA, 293 bp, Homo sapiens
aggggaccagcatcaaggagacttcagcgaagtgaagacagaggcttgggccctcagtgctggctgagaaggagggagggatccctgactgcctcatctctcaaccaagggaaaactgaagaaacctttttgtgggggccttggatatataaccctcccctctgtgaaggagttcctttctttcctctcctctacctttcactccagcttctattcagttccaggcttggggttaggtctcttcatcctcgttctaatggccttaggaaaaaaatgtatgatgcaatcctggg

SEQ ID NO: 335576 - DNA, 180 bp, Homo sapiens
gaggaggactcagatatgtaacaaccggtttttttctctttctagcccagagtttcttactatgatctggattcgtggggaggaaggctgggtagagctagactcatcatctgctttggtgttcttgggagcttatctcttttcctgccaggtagatagtttttcctttctttccttccc

SEQ ID NO: 335577 - DNA, 458 bp, Homo sapiens
gatcatgaaatgaacaaaaaggaagactcagaaatatttctactaattattattagtattgaaattgttggaatcatgatcaatgtgattttgagcccaaaacaaaacaaaaacaggtaattacacttcatactgagtgaagaattaatgctattaagaagtaagtagctacaggaaaatctgaatgttaataaaaaatgccctaaagggaattggttcattccttctcaatgatttttactgctgagtatccctttacaaatatcttcatttccccctttcttcctccaggttctaaaagagttttctaaagaaaaaaaaaagttatataataaacctcttagacaaaaattggttgtacttgccataagcagatcccaagtggtcatgggaaccactaaaataactcctaccatttctagaatagaattctcaaaagaagcacctctagggaattc

SEQ ID NO: 335578 - DNA, 135 bp, Homo sapiens
ctcctgcgtgattccatcgagcttaggatggtcgtgtagtcgggacccatgtcaggagcatggctcagccccagcttgtgtgcctcagtcaggcaggcctcacctcggggccatctcctgcgtgactccatcaag

SEQ ID NO: 335579 - DNA, 441 bp, Homo sapiens
cagataaaagaaaggatatagaagattagaataatacaataaagaattgtgaccacaccagaatgagaggtcatatacctttcaaacaccccaagaacattgattatattgctactttttacttgggcatgtattttttttttttttttagtttccaaatatatgaattttatgacttttaacaaatatctttttatcgtgaacttcaaatttaattgcattgatgtcggaaaacgtagtattactcattcttggaactttgttgtaacttgctttttaacctcaaatataaggatatcgtttcaagaccattggaaatagctgcagtgtgataaatgtaagggtaagaagagagtgttacaggagtgtttaccatcagtttgcgcatgtccaagtcatatgcctggtaggaaaactttaaatttgggatcacacattttt

SEQ ID NO: 335580 - DNA, 779 bp, Homo sapiens
ggagaaaagcatgacacaggcagaatcatgtttagtgatgctcagtggcaccaactttggagttctagagatagggtggccagagcagtggcagagggagtaaagagaccacactgagtcactgactacttcatgcagacaccaggattggggtctaactggaaagggggagaaggcgtccaagacaatgttaaggttctgagtgtgaagggctgggtgtgtcatctgagatctggatgtggaaggagatgctgttggtgggaagtggaaggcttggtttgcacatgctaagtgtgaggtgtgaatttcccaggcaaaaatgctcaggaggcatcaaaaccagtgtctgcagttcaggggtgaggtcctggctggagacccagatgtagcaatgtcggcacagagatgaggcctggggctaaggagatgggtgacactaccaagggagaatgctcaaggcaagaggaagtgagtctcactgatcaggtatgggagctgccatcacacctgtagcaggtagactgctgggcagcgtacccttcctctccacttgtctgggtctcgcccaccctctgggcccggccccacccactccgggaagccctctctagctattccatcccccaggcatccttcctttgctgtgagcttctcagctctggccatccccaccttagcagtgggtcttgtgttgccaccttggtgtagtccccaagcaccttgagggcaggatgacagttaacccccatgggacactgcattttctgacacagagcacc

SEQ ID NO: 335581 - DNA, 263 bp, Homo sapiens
tgggtcatcagcaggcatggtcgggtgtcatggctgtgccccgcagcacgcggtgtctgcctgcttggaggggcctccgcagtggggcactgcgtggccctgtaggatgcaggcaggctttggcaaggctggccctgctctaggtgggtgtctgaacctgttccctccccaggcagagcccgcaaggcgagcacacgctccttcatgacggggccgggtccagcgtccgctgccgctgggctctggggtctgtccggggtgcc

SEQ ID NO: 335582 - DNA, 138 bp, Homo sapiens
aataattattgatttccaaaatggacttcttaaagaggtgaggaatatctctgagtatttctgagttttttaaaagtccaaaaacttaagaaaataatacttaatgttcagcatgaagttgagattgggctgcaaaat

SEQ ID NO: 335583 - DNA, 405 bp, Homo sapiens
cctttgacagcaatacatacgcctagtacagctgagccatacaagtttcctttctctacaaaggactctcagcatgtcagttctgtagcgcaaacccaaaaacaatatgatacatcttctaaaactcactcaaattctcagcaaggaacgtcatccatgctcgaagacgaccttcagctcagtgacagtgaggacagtgacagtgaacaaaccccagagaagcctccctcctcatctgcacctccaagtgctccacagtcccttccagaaccagtggcatcagcacattccagcagtgcagagtcagaaagcaccagtgactcagacagttcctcagactcagagagcgagagcagttcaagtgacagcgaagaaaatgagcccctagaaaccccagctccggag

SEQ ID NO: 335584 - DNA, 372 bp, Homo sapiens
cctttgacagcaatacatacgcctagtacagctgagccatacaagtttcctttctctacaaaggactctcagcatgtcagttctgtagcgcaaacccaaaaacaatatgatacatcttctaaaactcactcaaattctcagcaaggaacgtcatccatgctcgaagacgaccttcagctcagtgacagtgaggacagtgacagtgaacaaaccccagagaagcctccctcctcatctgcacctccaagtgctccacagtcccttccagaaccagtggcatcagcacattccagcagtgcagagtcagaaagcaccagtgacgttcctcatcccagtgacgttcctcatcccagtgacgttcctcatccacag

SEQ ID NO: 335585 - DNA, 388 bp, Homo sapiens
acatcagctccccaccagatctccagctgcacggctctcaaacaggaacatcagctccccacaggatctccagctgcacggctctcaaacaggaacatcagctccccaccagatctccagctgcacggctctcaaacaggaacatcagctccccacaggatctccagctgcacggctctcaaacagtgaacaaaccccagagaagcctccctcctcatctgcacctccaagtgctccacagtcccttccagaaccagtggcatcagcacattccagcagtgcagagtcagaaagcaccagtgactcagacagttcctcagactcagagagcgagagcagttcaagtgacagcgaagaaaatgagcccctagaaaccccagctccggag

SEQ ID NO: 335586 - DNA, 383 bp, Homo sapiens
tctcaacaccattgcagctttggtaagcaaaatttcctgcagggagtatcagtactgtttcattgtcaattcagaaaaaatgataacacgttttaatatcagaaactttttggtgatgtgggaagatggattccaaagttcatctgtctgagagaatgtagacctacatgtctacatttgggagtaaaggagatttaaaattaggtaaaatgtcctttgggtgtatgcagaggtctattagtcctttttcttctcccctccaagggcactgactagtgattttcttcgggtgcaacatcttagttcatgttgaatgactgttatgtactgggtgctgtgatataaatgagtagatgggcaaatgagtgaattcagtgcccagc

SEQ ID NO: 335587 - DNA, 350 bp, Homo sapiens
cttgggtatggggaggatgctaaaaatataacagcagctcctcacagaaactgtattcagagactctctcaaatctccaaaaacctaatgtggataaatttcctaactcacttctaagccccttcttggaaactgtaatgcggtttatctaactctctttggaatatagcatctctcatcttcattcctcagccgaaaacaaggcaagaagaatcctatttgaataccccgttggaatatgaaagtactatcatggcagcacaagttaagaacactgttctgtagatccgcatcaggcccggctccttgaggcaggccttcactgagctccctctgttcaggtctgtgct

SEQ ID NO: 335588 - DNA, 221 bp, Homo sapiens
atgggatcctcagaacttagagagagaatatgtatatgggatcctcagaacttagagagagaatatgtatatgggatcctcagaacttacagagagtatatgtatatgggatcctcagaacttacagagaaccctgcaaatcaatgggaaaggaatgatgcctgcactaggagaggagcgcgtgacgaccgttcctggaaaacgagccaaaaacggccaga

SEQ ID NO: 335589 - DNA, 205 bp, Homo sapiens
tcatacaagatttggtatggaatgtgttttcacttctcttgggtatatacctaggagcagaattacagggtcatatatggtaatgcatgtttttctccaagaatatgatatatattaactatagttttattaatatatagtgattctatgtttaattatttgaggaaatgccaaactgctttccacagtggctgtaccattttac

SEQ ID NO: 335590 - DNA, 385 bp, Homo sapiens
aaaaaaaaaaagaggaaaagaaaagaaaatgtgttgtcaagggcctggagatctctgaaatacaaaagcaggtggagtgtgagtgcagagaggcatgaaagggatgggaagatgtgagcttgtggtcagcaaatagcttcctagaggtcaagagttctaacgtggaacagctctatgtggtaacgatgcccaggctgtgggtgtaggggactgaaatgcaggggaggcaaaggtcactggagttgaagtcaagaagtagtactacagttcccggcttgtggtttggttttccacactggtggtcaaggtacccaggatagtggcagaatcaagggagagaaagactgaacaggtaaatttttttcttcagtaccaaacattttat

SEQ ID NO: 335591 - DNA, 519 bp, Homo sapiens
aaccctagccctaaaccctaatcccgactctaacattcaccataacctggagcatcaataaccccaagccaaatcccacactctatctccagatctaactccagtcctacacctgacctcaaacctcagtcccaactcccaactctgacaccatcactcatgaggagcttgaccacacggcagaagctgaagtgtgttcacatgaacctgtttcctctccttcctgggcaaagagctgaactacatttcccagcctcccttgcagctgggcgtggccacggcctgagttatggacactagaatgtgggcagaagtgatggtcagtccctccaggcttagcccccgaaaacctcccatgtgagcctcgaaactctcttgccctgttcaccagcagcaaacccagccacaatgccaaagctccctggcacagtggagtcacaagatggaatggccacatggcagaagaaagccacccaccaactaggaacactctcgtaaaactttgcctgagaggccagg

SEQ ID NO: 335592 - DNA, 143 bp, Homo sapiens
tgccaggaaaaggttaatgtcaggaggtaaatgaggcaggggaaagggaaagaaagcaatggacacggaggctattttagattagaaaagccttccctgaggagccagcaactgaggtaagagaaacaaaacaatccatgtaa

SEQ ID NO: 335593 - DNA, 376 bp, Homo sapiens
agcctgccctgatctggtgccaacctaccttgccagcctgggtccctactgtgtactttatctcctcaactccagccacatcctatggctcgtcttatcccagacctgctgtgcattttcatggccgaccaccttggctcatagacaagcttgttcctagcacttacagtgttgtgggggaggaggattaatcacataatcccgtaaataaatatatcctaacaaactctaagttcagcgtatctttaggaactcaaagagaggttataatggggatgggatttagactggggactcggagaaggcctctaggcatgggaggcactgcagtgtattggattcttgttacttcgaatgcttggggcggggcttattt

SEQ ID NO: 335594 - DNA, 549 bp, Homo sapiens
tggacaagatctggaaggcggcagagagagaggtggttgaaaggaggcttcccggcaaatgagaacctagttgtaggcaaataatgtcagccttaggaggcaggggtgctgctattctagggatagatcatttggaggttggtttaagcattgtgttgcacagtcgatcaggttgtgctcatgcctgctttgcttctaccccataagttcgtagaaccaaagcacccaggatacgccactgtggttcagaggaaggccagaacagcactcccctgccaagccacagggtcctttattcttgataagaaggatgctgagtaggtctcaatgacacctttttggggatctatatcagacgactgcatttcattccccagaatctgcagggacaggacgtgagacagtggacccctttctcctctcaagcctgtgagagaatggggaaccctgagccagtgtcctcactctaagaaacagctgcattttggatggctgacatgggtggagtagaaggtctccctcaggaccctggttgtcattggtgccaac

SEQ ID NO: 335595 - DNA, 384 bp, Homo sapiens
gaatccattggaacaggttaagggaacgcgaaccacagtcattcagtggagctgccctggcctgctggctggtggatttctggggcacttagctgtttgttatttctggggcacttagctctttattatcctaggatctcagaagaatagaacaagagttatctattgagcaaaagcctatcacatgccaggattttacctacattctctctaatcctcccaccaaccttgcaaggtcagcatgatatcagcaagatatcaatgtcaccatttttatacagctgaggaaacctgatttcagagtgggagtgacttgcctgatacaacaaggttcatgtaaatagcagagtcaagagcctcctaagccggaggccacagggactc

SEQ ID NO: 335596 - DNA, 590 bp, Homo sapiens
tccatgctgttcccgtccacatttcattgtgtccaccattctctttttgggaagcaaactgctccttgagcctgttacctctctctcaacccctccccagcctctttcctctcatcacagccacacttcttgaaaaatgatgtctgcattcactgtcttcccttccacccattagctcattgcaggcggttttctacccacaccctctccagagtcaccggtgacttttttgttgccaaatccatcctcctctgctgttcccatcgtgttagtccactagagaatatctggcatttgtgtttgtccttttcacacattgtctttgggctcctctgtcctcagccaggcaggaaagggcaaggggagtgccatgttctccagatgtcttgcctgcccctctgacgtcctttctgtctcctttgtgagctcctcgtcctccacttgaccctccttcatggggacatctcccctgggaaagagatgccatctagaaacagcccaatagtgtttcctccccaccctgtacatccacgtctccaactgctactggacacctccttgtggacgtcccacaggtatctcagactctg

SEQ ID NO: 335597 - DNA, 344 bp, Homo sapiens
atggtctaaaagcatagcattgccaataaaggaattagaattctaaatatagcagtttatatttaacacgtactaattttaagctgccagaatactgaatatgatgaatagcaacattcatgtacagcaaccaacaagctttgtaatgtacaaagttttgttatttctttatccaaaactataccaaagacatgttcactcacatatgcaggattatcctaaaaagatacatgctggacaactgcaagatgtcataggttaaacataccctataaatactttgttctcaaaatattttcattcatattctatgaatagccgatgttttgggatttggccattgt

SEQ ID NO: 335598 - DNA, 236 bp, Homo sapiens
acaagtgaaacttaggagtgctaatttagtaaaatggctgtcaagatctggcagactgccttacatcatggctcatgcctgtaatcccagctttttgggaggccgaggtttgcttgcttaagcccaggaattcaagaccagcttggatgacatagtgagacctccatctccacaaaaaataaaaaattagctgggcatgttggcacacctgtagtcccagctactcgggaggctga

SEQ ID NO: 335599 - DNA, 88 bp, Homo sapiens
tggatcccaaatttctcacttatagccaggcccttatatgaagccacaagggagggtgaaaaggaacccctcctctgaaaggctgacc

SEQ ID NO: 335600 - DNA, 458 bp, Homo sapiens
caacctttgaaaagaccaaagatcaattcctggtactcatgtgggctggggacaggacccgttcccaccagccagactagggaaactctcaatagatcaattcctgatactcatgtgggctggggacaggacccactcccaccagccagactaggaaaactcccaatctgtgagcattaggtggagttctcagaaaatcttgcctcaggaatggggataattagccctagactgagccctgctcctgactcgcctacaaaatcataaaagcaagacctaaaatgatcaaaccattcccagataattcactttatcccagaacaaagctccagatgatctaggggttaccaaagtgtccacaccctgcaaggtaaactcacagtgcctgacctcggagtgccaggcgtgcagaggagcagccaagggcaaacactccaaggagagtcgcctggcaaagc

SEQ ID NO: 335601 - DNA, 587 bp, Homo sapiens
agtgatagtaaagtgattgaaatatttattccatcctctacaaaactcaagtaaaaatagttttctgcatgtggtcctcaatatattcagtccatgggttcaaccaatcacaggtgaaaaatataaaaaaataaaaataaaaaagcaatacagcgtaacaactatttacatagcattgacactatattaggtgttataaggaatctagagatgattgagagtacacaggaggatatgttcaggtcatatgcaaatactacaccattttctatcagagacttgattgagtctctgtggattttggtatccttggggatctggaatcagtcccccacggaccctgagggctgagtgtgcgtccatcctgggattgatcagtgtctccccagagtctccgagaggctcagtcttgctctctcagtgtgattttgtgatattataagcatgtgactggtctgtgtccccagtccctggcagtagagttcttaagcccttgcagttttctgagacctgtaggggtgacaggagcttctttttttctgaggtgactcttggtaggctcctaggaagcttcagggtggccctgg

SEQ ID NO: 335602 - DNA, 497 bp, Homo sapiens
ggtgctcatcacttctctccactctgttcttcctttgattggccttcggaaaacctttaaaatccagattttgatcctgtcctttgtatagagcacacttgacataactaactccatcttagaaaaagacaatttgtatttcacagggcactctgccatcaagggtaagatgctttgtttaataaacaaaaaaaaaagacggccaggcacggtggttcacgcctataatcccagcactttcggaggccgaggcgagcggattgcctgagcttgggagttcaaaagcagcctaggcaacatggcgaaaccccatctctactaaaaatacaaaaaattagccaggtgtggtggcgggtgcctgtaatcccagctactcgggaggctgaaacaagagaatctcttgaacccgggaggcggaggttgcagtgagctgagatcacaccactgcactccaggctgggtgacagactgagacgctgtctcagtaaaataaataa

SEQ ID NO: 335603 - DNA, 4225 bp, Homo sapiens
gagtgcgttcgcggctgctttgacctggtgggcgccgcctccggcactgcaccgaggcggggcgccagcgcccaggttgctgggctggccttggcgcccccttcccctacccagagcgcaggcaggcaggggggtcccgccgcgccccttcagcatatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctttttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagatcctcaacaagtacgactcatggatttccttcctgagcagcgtgcggtactggatggccttcaacgtggagcgggcctgccagtcctactttggctgtgtgcagtgtattagtgggcccttgggcatgtaccgcaacagcctcctccagcagttcctggaggactggtaccatcagaagttcctaggcagcaagtgcagcttcggggatgaccggcacctcaccaaccgagtcctgagccttggctaccgaactaagtataccgcgcgctccaagtgcctcacagagacccccactaagtacctccggtggctcaaccagcaaacccgctggagcaagtcttacttccgggagtggctctacaactctctgtggttccataagcaccacctctggatgacctacgagtcagtggtcacgggtttcttccccttcttcctcattgccacggttatacagcttttctaccggggccgcatctggaacattctcctcttcctgctgacggtgcagctggtgggcattatcaaggccacctacgcctgcttccttcggggcaatgcagagatgatcttcatgtccctctactccctcctctatatgtccagccttctgccggccaagatctttgccattgctaccatcaacaaatctggctggggcacctctggccgaaaaaccattgtggtgaacttcattggcctcattcctgtgtccatctgggtggcagttctcctgggaggggctggcctacacagcttattgccaggacctgttcagtgagacagagctagccttccttgtctctggggctatactgtatggctgctactgggtggccctcctcatgctatatctggccatcatcgcccggcgatgtgggaagaagccggagcagtacagcttggcttttgctgaggtgtgacatggcccccaagcagagcgggtaaagtgcaatgggtaagggagggaaggggaatggaagagaaaagacagggtgggagggaggagggagtgctgtgttttagtctcttaatggtccaaaggacaaatctaaaatgcaaagaacggtgatgtagtatggcctgacagctctgtttagaggaggcaacactgatcccccagatgcagggctgcaggggattctgtgttttcagactgcctgtctgcttgcatctgcacataggcagtagcctcctcctgggctccagagggcactcagaagttgtgctaaaccaagttaagtcccattcagtggcaacttgtgataggtacctgagtgacggcaacctgcggaaggaggttctcccagcccatctgaacacaaccagaggtggcaggagaatttctactgagcgagctgggccggttagtgtatgtcacccccaccccacccctaagtagtcatcaatgcaataagattgcgcctgagatacaaggcccagaagcctgatctttgggcatcagaaaacagggtccaggaatggtgctttatgtgagataccccactccacatcaacattccagggatgagccaaaccagcagggagttagcactgaactgcttttaaaagtgcacattaaaaaggaaagtttgccaggaggaacaaagagattgtggtggtgctaaaggaggccataagctacacagaggccttgggtgttccacctggaaactgctcagacgtctagatgggttcttagcttgtctgtgatctctgctggggagataaaaagattaagccccaacatgttcagaaaagaagtgaagtcttgggtattttaacctgtatactcttgaattcctctcaaattcagctctgatctgaggctaagacacactccccacttcactttcttcaaagccacattttttgaggtatcactgcagtcacctcttctaccctcatcatcataggtaaggttttcaaggtggcaattggggcggagccccggctcttatagaagcttcagcaggaggcaagcgtgttctcagcacatatgggaactatgaggagcctctgatcaaattggctacaatcttggagctgcttggacggattccttggcagccgggttagcatgtgtgactttcaggctactgttcttgacaatcatctccaatggaaagcttttcagtgttcccaaagtgaactctcaaatccaaaatggttatctttgagaccatccattctcctcagtggcttctccagggaattcttacagccaagttgtgacagtcactgcatttgcctgcttctttccagaaaccaaactaggagatgaaactggttcctacatcctaaggttcttgctttctctctcatgcctcctgaggctgtttttggctgttttccctctgctgcttttggggaatgaggggaagccattttccagtgacttgcaatccaggctgttctcagcgttttgagtttaaaacctgggatcctgactaagcctttgacttaagggttgcttgcttgccctccaaatgtcctttctcagaggggccagctaacccgtgcagaaccagcactaaggtggacagcagacaagagggcaagcctctagtgtaccaagtgcttcctacaaagacgcaaggtgtgctctgagccacagatgggcaaaccctggtgctttccttcatctcccacgaactcaagggttttccaggtgtagctaacagttgccacatcacacagacctcgagtttctggtaagactgctggttgacatcagacccaacccatgaaggctggaaggcagcaggcatttgctaaggcagctgatccaggcaatcgttctgctggccaagaagttaaactattttgagcattagaatggaggaaatccggtcagccaagtgcagagttcagacttcgctaagggcttgtttttcttcagcatttacttgaagattaatgtaggatgacaggctctcctggctgtcctaccatcagctctgccttgcactgtggtcgtcaactttcctcaaatcaaaaacaggcaggtacaggtagtgggctcacaacgtttgacctcgactggtttttctaagttattttgtacatttttcagcagcaaaaccaaactgggtcttcagctttatccccgtttcttgcaagggaagagcctttatacaattggacgcattttggtttttcctcattgagaattcaaatcctcttttgtattgtttctacaataatttgtaaacatatttatttttacctgcttttttttttttttttaattttcaggtcaagttttttatactgcacttatttgtcaaaataaagattctcacatatgccggttatctcgaaactac

SEQ ID NO: 335604 - DNA, 4128 bp, Homo sapiens
gaggggcatggagccgccgcgggcctgctgagctccggagcgcggcagccggcggcacgatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctttttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagatcctcaacaagtacgactcatggatttccttcctgagcagcgtgcggtactggatggccttcaacgtggagcgggcctgccagtcctactttggctgtgtgcagtgtattagtgggcccttgggcatgtaccgcaacagcctcctccagcagttcctggaggactggtaccatcagaagttcctaggcagcaagtgcagcttcggggatgaccggcacctcaccaaccgagtcctgagccttggctaccgaactaagtataccgcgcgctccaagtgcctcacagagacccccactaagtacctccggtggctcaaccagcaaacccgctggagcaagtcttacttccgggagtggctctacaactctctgtggttccataagcaccacctctggatgacctacgagtcagtggtcacgggtttcttccccttcttcctcattgccacggttatacagcttttctaccggggccgcatctggaacattctcctcttcctgctgacggtgcagctggtgggcattatcaaggccacctacgcctgcttccttcggggcaatgcagagatgatcttcatgtccctctactccctcctctatatgtccagccttctgccggccaagatctttgccattgctaccatcaacaaatctggctggggcacctctggccgaaaaaccattgtggtgaacttcattggcctcattcctgtgtccatctgggtggcagttctcctgggaggggctggcctacacagcttattgccaggacctgttcagtgagacagagctagccttccttgtctctggggctatactgtatggctgctactgggtggccctcctcatgctatatctggccatcatcgcccggcgatgtgggaagaagccggagcagtacagcttggcttttgctgaggtgtgacatggcccccaagcagagcgggtaaagtgcaatgggtaagggagggaaggggaatggaagagaaaagacagggtgggagggaggagggagtgctgtgttttagtctcttaatggtccaaaggacaaatctaaaatgcaaagaacggtgatgtagtatggcctgacagctctgtttagaggaggcaacactgatcccccagatgcagggctgcaggggattctgtgttttcagactgcctgtctgcttgcatctgcacataggcagtagcctcctcctgggctccagagggcactcagaagttgtgctaaaccaagttaagtcccattcagtggcaacttgtgataggtacctgagtgacggcaacctgcggaaggaggttctcccagcccatctgaacacaaccagaggtggcaggagaatttctactgagcgagctgggccggttagtgtatgtcacccccaccccacccctaagtagtcatcaatgcaataagattgcgcctgagatacaaggcccagaagcctgatctttgggcatcagaaaacagggtccaggaatggtgctttatgtgagataccccactccacatcaacattccagggatgagccaaaccagcagggagttagcactgaactgcttttaaaagtgcacattaaaaaggaaagtttgccaggaggaacaaagagattgtggtggtgctaaaggaggccataagctacacagaggccttgggtgttccacctggaaactgctcagacgtctagatgggttcttagcttgtctgtgatctctgctggggagataaaaagattaagccccaacatgttcagaaaagaagtgaagtcttgggtattttaacctgtatactcttgaattcctctcaaattcagctctgatctgaggctaagacacactccccacttcactttcttcaaagccacattttttgaggtatcactgcagtcacctcttctaccctcatcatcataggtaaggttttcaaggtggcaattggggcggagccccggctcttatagaagcttcagcaggaggcaagcgtgttctcagcacatatgggaactatgaggagcctctgatcaaattggctacaatcttggagctgcttggacggattccttggcagccgggttagcatgtgtgactttcaggctactgttcttgacaatcatctccaatggaaagcttttcagtgttcccaaagtgaactctcaaatccaaaatggttatctttgagaccatccattctcctcagtggcttctccagggaattcttacagccaagttgtgacagtcactgcatttgcctgcttctttccagaaaccaaactaggagatgaaactggttcctacatcctaaggttcttgctttctctctcatgcctcctgaggctgtttttggctgttttccctctgctgcttttggggaatgaggggaagccattttccagtgacttgcaatccaggctgttctcagcgttttgagtttaaaacctgggatcctgactaagcctttgacttaagggttgcttgcttgccctccaaatgtcctttctcagaggggccagctaacccgtgcagaaccagcactaaggtggacagcagacaagagggcaagcctctagtgtaccaagtgcttcctacaaagacgcaaggtgtgctctgagccacagatgggcaaaccctggtgctttccttcatctcccacgaactcaagggttttccaggtgtagctaacagttgccacatcacacagacctcgagtttctggtaagactgctggttgacatcagacccaacccatgaaggctggaaggcagcaggcatttgctaaggcagctgatccaggcaatcgttctgctggccaagaagttaaactattttgagcattagaatggaggaaatccggtcagccaagtgcagagttcagacttcgctaagggcttgtttttcttcagcatttacttgaagattaatgtaggatgacaggctctcctggctgtcctaccatcagctctgccttgcactgtggtcgtcaactttcctcaaatcaaaaacaggcaggtacaggtagtgggctcacaacgtttgacctcgactggtttttctaagttattttgtacatttttcagcagcaaaaccaaactgggtcttcagctttatccccgtttcttgcaagggaagagcctttatacaattggacgcattttggtttttcctcattgagaattcaaatcctcttttgtattgtttctacaataatttgtaaacatatttatttttacctgcttttttttttttttttaattttcaggtcaagttttttatactgcacttatttgtcaaaataaagattctcacatatgccggttatctcgaaactac

SEQ ID NO: 335605 - DNA, 389 bp, Homo sapiens
gaaccttgcgtttgggacttctaggcaatgagacaattctcccacctctgctgcttgtcatctgacccttcctggtgctgttccatggggaaaataatggcaccatgtcctgggtagcctcttcttatcacagtaagcaaataaaagcttgactgttactttcagtggggctagttgtcctaattcaacaccttaacacctgaaagtactcacatacatgccccctctctctttctctctctctctctctctcaatttgacaaaggagctgagtggtcaattaagcacaatgcctttttggaaaaacaaaaagcctaaaagtccttcagggcacagtagaggtgctggtggttcatctgcaagagtctgagggtaccgcagaacacttg

SEQ ID NO: 335606 - DNA, 387 bp, Homo sapiens
ttgtggcagtttgttacagccatcctaggaaactaatgcaccccctttcatctcagaaatcctatcatctaacctctttgtctttaatatcaaatatgcatccatgtcacctacacccaatagaacacagcaccttggacatagtacattcttgccaaatatggttgacaaaggtgggagtagaggagggagtgaagaagagacctgaactcgcaccaggagagtaaaatgacttgggtgcaagctggcaagcagaaggcctgtctggctaaatattaacacaaataaccacaaagagtaaatggtagagagatgctgctctaagacaataccacccgacatccatgtctctttagttcagcatgtctgagattaagaattgaagac

SEQ ID NO: 335607 - DNA, 304 bp, Homo sapiens
tccttacagaagtggctgattccagggctatggcaaagaaaatataagataatcctagattaacaacttgtagtaccagaaaataagaaatgctcaccaaaggtgagcaggttgaaaaggcacagatgccaacttgaaagagttcccaatggccaaagcagaagacaaataactaaggatagtataggattataactcatggaataaaataaacatctatgagtccatattgatataaataattgaataaatagaggaaaaagggagtattccttcttacagaagaattccagctaatgggcca

SEQ ID NO: 335608 - DNA, 218 bp, Homo sapiens
acactgtattagcctcgttcactgccagaggggcccctgaaggggacacagtgacacagtatctactgatactgcccttattcaagaggtcagtgctgtccttcacccctacctcattccctacaccctggctagaatctcataactcctccaacaacttaaaatcactctctcacctttgtgttagatttctgtttccaactctgcccctgtcccct

SEQ ID NO: 335609 - DNA, 918 bp, Homo sapiens
gactcgcgtcggttggcgactcccggacgtaggtagtttgttgggccgggttctgaggccttgcttctctttacttttccactctagcctgggtgacagaactagactcggtctcaaaaaaaataaaataagggaataaatgcagaacgaattttaatacaaaaggccttatctccaattgatggctctttttgccctgttaatgattgaatataattaaggatccatgttaacttcgacttttttataatcccatgtatccatcatttttctaatcccataattgatttagaatactgtcttctatggacctaaaatctttttctgtcagaaatttcagtgagaaggtatgtgcattctctcataggacatgtgctaaaattttggatgatgaagattaatatggcctttttacaagattgccacacaaatttgtacaatgcgtggataacaatttttttaagtgagttgtttaaaaggctcacttaaaaaaatcagttgggcatgatgaggttgaacttcaagttatctaagttgtcgacttttatcatacggatcattagttcctgttgtttcaaaactcatgtgaacctttaacgatgggctgagccaacggtggctctgtactacaaaacgaggacagggctgccagcttaaagtggcctgtttgaagattctacaacagatggcttttatgacccaaccataagcagatcttaagtctctaggtgaagaatttaaccgtgctaaccgggcacgacattggttctgctttaaccagttactatctttccagccgtggggaaattgggagaaacccggccttagcaaattctaatctttgggcacagacacggtctcatgggttgcccggttgactggagtccgggatcagacaggttttcgctctagccccca

SEQ ID NO: 335610 - DNA, 503 bp, Homo sapiens
  misc_feature (19)..(19): n is a, c, g, or t
  misc_feature (33)..(33): n is a, c, g, or t
  misc_feature (67)..(67): n is a, c, g, or t
  misc_feature (75)..(75): n is a, c, g, or t
  misc_feature (196)..(196): n is a, c, g, or t
  misc_feature (264)..(264): n is a, c, g, or t
atgggtttttcctaatatntcatttcaaattancggatacaaatttgccagagaaacaattacatgntttacctnaacatcaaataatctccagtttctaagacagatgcatttcttgttcaatttcccaaaagtaaataaaggctttctaactgaaaacatttgcatccctagctctctaaagtaattaaaaagnaaattacaaaaaatgacctctaagcttctgaacagcccacttagttacataaagtactttctgtcccnacactttctctaattcaaaagatatttacttcctaagtacacgacaaagtcttcatttcaaaccattcactcagtttccatggtaacattgcgggcttccttggctaccataagtcgcattagttgactgtggaatttctcaatcttctttacatctttgtttggtgtataaaacagaccaagctcaagatgtaaagaagattgagcttggtctgttttatacaccaaacaaactaaat

SEQ ID NO: 335611 - DNA, 408 bp, Homo sapiens
gactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaat

SEQ ID NO: 335612 - DNA, 912 bp, Homo sapiens
aaaaggagaacagggatccccaggaagtgtctcacgtccggcgctgtggaattagttgctgatcaagtagggagaaaatgtaaatatcaccttttctcctgctccccttgcccatccgtgtgacggggggactcacacctaaggctgagggcatgggggaggggaaatgagaggtcccttatcatattccgaagtctatccgtgactttaaaaagctgttagggaccttcagagggttcataaggccaaaaccctactgtgcaaatattggctgaaatgtttgtttcacacacagctcccacacccattgaaccaccctataagtttttaaccttgaccacaaggataacagggagaaaacaaggatggtgccagctcaactgtacaggaaaatggttacttcatgagtggaccagatcagcagcctgggtctacttgaagcgcccctttcagggtcaccttgcggtatcagtctccccacaaacaaacgctccccagagtttttttattttttaagccgacctataaacaagcagtttgtccctgcttgctcgcctggcactaaggacccacagagatgtcactcggtttaatgctgtctcattttgatgcctggcccgtttggggttgccgcccctttactacgccgggaccctcctcggcctcaggctcccaggcactgcaggatgctggctgggcactcagcagtcgaggcgctgggcatgctcagtggctgggacccggcgggccgcgggggagcgcgcctcggcccaatgcggctgaggggcggagcgagtttcccggggaggcctgctgattggtgggatggcctgtttttcaagccttgcactgcagagggaaggtgggggtagaagggttgagggtaccaaggtaggttgcaaagcgtagtaa

SEQ ID NO: 335613 - DNA, 2955 bp, Homo sapiens
gtgctcaccgccgcttccggtccgcgtgaggtgcattctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctgaaaccacagcttctccagggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaattggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggtagtcgctggccccaggaccccctcctgattttggctaggcatcgtggaaccagctccagcccctgaagaaacgatagatgtgcaggttgtgcggaagaggctgagtggaaaatggtgtgagccccaccgctgtgcatcgaatgagggaagtggcagcagagaggccagagctgccccctctctgtctcttcaatggacccttcacaagtgtttctcctgcccttggggctgtcttccttctcctgaaatccagagactttcttgctcatcccttctccctttcacttctgttctctgctgcagaaagcagacttgcatatccctgatgagcagctcggctacttttgtaaacttcagatttggagagaaacacgaaagtctgaatcctgaccccttgagagagagtgatctggcgagggccgatgaaggggctgggcctggtcttgccttctcttctctcggttgctccctctgcctaggcccctggtactcagtcacggcagccaggagaccccaggtgagtttctgagcgcatacgtagttggttcttacccccaggtgtcacacggggccgagagctgagcaagaatttggaatggaagttatgaccaagggaattatgctgttcatttataatagtggacattatggagagctctgattcctacataatatgaataaggatggataggccgggcgtggtggctcatgcctataatcccagcacgttgggaggctgaggcgggcggatcggttgagctcaggcgttcgggaccagcctggccaacatgatgaaaccccgtctctaccaaaaatagaaaaaaatatagccgggcctggtggcgcacgcctgtagtcccagctactcgggaggctgaggtaggaggatcgcttgagcctgggtagaggctgctgtgagctgaaatggcgccactgcactccagcctgggtaacagagcgagaccccgactcaataaataaataaggatggataaattgtagcgtatgcaccattcattatgctaagacattttaaagtaattatgagaaacgctctactaatgatttgtttttatttgtatttttctgcttattagacaaatatatactcattttaaaaagg

SEQ ID NO: 335614 - DNA, 475 bp, Homo sapiens
aaataaataaataaataaacataaaaagagttggatgatgttggattataggaggaagaagaagggaactgatgcttattgaaggattgctgtgtgggatttgatcctgaccacagtgcactgagataggtgtcattctgcccacttcacagcagaagagaccaagactgaggggaacactcatgtgtgttttgaaatctggaaataacttgttctcctagtcctagaaggatgggcagggctttgatttccagagctggctttgcctttgaaatacctatgaaaatcacctgggtctccacagtggaaagaggccagaagatcagtgagcagattgtcattggcacccctgggaccgtgctggactggtgctccaagctcaagttcattgatcccaagaaaatcaaggaagcttaaggagtaaagggataattgactgtggccgtccggaagagaccccagggatcctctagat

SEQ ID NO: 335615 - DNA, 3316 bp, Homo sapiens
gtgctcaccgccgcttccggtccgcgtgaggtgcattctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctgaaaccacagcttctccagggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaattggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggtagtcgctggccccaggaccccctcctgattttggctaggcatcgtggaaccagctccagcccctgaagaaacgatagatgtgcaggttgtgcggaagaggctgagtggaaaatggtgtgagccccaccgctgtgcatcgaatgagggaagtggcagcagagaggccagagctgccccctctctgtctcttcaatggacccttcacaagtgtttctcctgcccttggggctgtcttccttctcctgaaatccagagactttcttgctcatcccttctccctttcacttctgttctctgctgcagaaagcagacttgcatatccctgatgagcagctcggctacttttgtaaacttcagatttggagagaaacacgaaagtctgaatcctgaccccttgagagagagtgatctggcgagggccgatgaaggggctgggcctggtcttgccttctcttctctcggttgctccctctgcctaggcccctggtactcagtcacggcagccaggagaccccaggtgagtttctgagcgcatacgtagttggttcttacccccaggtgtcacacggggccgagagctgagcaagaatttggaatggaagttatgaccaagggaattatgctgttcatttataatagtggacattatggagagctctgattcctacataatatgaataaggatggataggccgggcgtggtggctcatgcctataatcccagcacgttgggaggctgaggcgggcggatcggttgagctcaggcgttcgggaccagcctggccaacatgatgaaaccccgtctctaccaaaaatagaaaaaaatatagccgggcctggtggcgcacgcctgtagtcccagctactcgggaggctgaggtaggaggatcgcttgagcctgggtagaggctgctgtgagctgaaatggcgccactgcactccagcctgggtaacagagcgagaccccgactcaataaataaataaggatggataaattgtagcgtatgcaccattcattatgctaagacattttaaagtaattatgagaaacgctctactaatgatttgtttttatttgtatttttctgcttattagacaaatatatactcattttaaaaaggcgtgtgtgtatataaagtgagagtgctctctatcccttctcttctgggatcctgattcctggcagcttggtgaatattctaccatattgccttttatttgcataaacccatttttcttttacaaaaacaggaacattctgttcacactactatgcaacctgctttcactgatcagcatgtgttagacatgttgacatgtccaatacacacacatcttccttgccctggaaacaccatccaccttcctttctgcgtgtagctgtcccggcatttatctcctggttcctctagtgacaggcatgggggatttctagtacatggctgttatccacagtaccacaatgaacattttttttttctt

SEQ ID NO: 335616 - DNA, 2840 bp, Homo sapiens
gtgctcaccgccgcttccggtccgcgtgaggtgcattctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctgaaaccacagcttctccagggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggtagtcgctggccccaggaccccctcctgattttggctaggcatcgtggaaccagctccagcccctgaagaaacgatagatgtgcaggttgtgcggaagaggctgagtggaaaatggtgtgagccccaccgctgtgcatcgaatgagggaagtggcagcagagaggccagagctgccccctctctgtctcttcaatggacccttcacaagtgtttctcctgcccttggggctgtcttccttctcctgaaatccagagactttcttgctcatcccttctccctttcacttctgttctctgctgcagaaagcagacttgcatatccctgatgagcagctcggctacttttgtaaacttcagatttggagagaaacacgaaagtctgaatcctgaccccttgagagagagtgatctggcgagggccgatgaaggggctgggcctggtcttgccttctcttctctcggttgctccctctgcctaggcccctggtactcagtcacggcagccaggagaccccaggtgagtttctgagcgcatacgtagttggttcttacccccaggtgtcacacggggccgagagctgagcaagaatttggaatggaagttatgaccaagggaattatgctgttcatttataatagtggacattatggagagctctgattcctacataatatgaataaggatggataggccgggcgtggtggctcatgcctataatcccagcacgttgggaggctgaggcgggcggatcggttgagctcaggcgttcgggaccagcctggccaacatgatgaaaccccgtctctaccaaaaatagaaaaaaatatagccgggcctggtggcgcacgcctgtagtcccagctactcgggaggctgaggtaggaggatcgcttgagcctgggtagaggctgctgtgagctgaaatggcgccactgcactccagcctgggtaacagagcgagaccccgactcaataaataaataaggatggataaattgtagcgtatgcaccattcattatgctaagacattttaaagtaattatgagaaacgctctactaatgatttgtttttatttgtatttttctgcttattagacaaatatatactcattttaaaaagg

SEQ ID NO: 335617 - DNA, 2060 bp, Homo sapiens
caggcaggtagaggcggggttgaatcggcacggaggcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggtagtcgctggccccaggaccccctcctgattttggctaggcatcgtggaaccagctccagcccctgaagaaacgatagatgtgcaggttgtgcggaagaggctgagtggaaaatggtgtgagccccaccgctgtgcatcgaatgagggaagtggcagcagagaggccagagctgccccctctctgtctcttcaatggacccttcacaagtgtttctcctgcccttggggctgtcttccttctcctgaaatccagagactttcttgctcatcccttctccctttcacttctgttctctgctgcagaaagcagacttgcatatccctgatgagcagctcggctacttttgtaaacttcagatttggagagaaacacgaaagtctgaatcctgaccccttgagagagagtgatctggcgagggccgatgaaggggctgggcctggtcttgccttctcttctctcggttgctccctctgcctaggcccctggtactcagtcacggcagccaggagaccccaggtgagtttctgagcgcatacgtagttggttcttacccccaggtgtcacacggggccgagagctgagcaagaatttggaatggaagttatgaccaagggaattatgctgttcatttataatagtggacattatggagagctctgattcctacataatatgaataaggatggataggccgggcgtggtggctcatgcctataatcccagcacgttgggaggctgaggcgggcggatcggttgagctcaggcgttcgggaccagcctggccaacatgatgaaaccccgtctctaccaaaaatagaaaaaaatatagccgggcctggtggcgcacgcctgtagtcccagctactcgggaggctgaggtaggaggatcgcttgagcctgggtagaggctgctgtgagctgaaatggcgccactgcactccagcctgggtaacagagcgagaccccgactcaataaataaataaggatggataaattgtagcgtatgcaccattcattatgctaagacattttaaagtaattatgagaaacgctctactaatgatttgtttttatttgtatttttctgcttattagacaaatatatactcattttaaaaagg

SEQ ID NO: 335618 - DNA, 2120 bp, Homo sapiens
gtgctcaccgccgcttccggtccgcgtgaggtgcattctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctgaaaccacagcttctccagggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaattggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggtagtcgctggccccaggaccccctcctgattttggctaggcatcgtggaaccagctccagcccctgaagaaacgatagatgtgcaggttgtgcggaagaggctgagtggaaaatggtgtgagccccaccgctgtgcatcgaatgagggaagtggcagcagagaggccagagctgccccctctctgtctcttcaatggacccttcacaagtgtttctcctgcccttggggcgtgtactctccctttctaacctgaggactggcatggacgactttctcctcttgcgtcaa

SEQ ID NO: 335619 - DNA, 1459 bp, Homo sapiens
gtgctcaccgccgcttccggtccgcgtgaggtgcattctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctgaaaccacagcttctccagggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaattggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgaaagaaaacctccccctgcgcttggggcggcccccccgtttttttatagaggggggcgggcctaaaaaaaaatggggtggaccaac

SEQ ID NO: 335620 - DNA, 1731 bp, Homo sapiens
gtgctcaccgccgcttccggtccgcgtgaggtgcattctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctgaaaccacagcttctccagggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaattggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaactcctgattttggctaggcatcgtggaaccagctccagcccctgaagaaacgatagatgtgcaggttgtgcggaagaggctgctgtgagctgaaatggcgccactgcactccagcctgggtaacagagcgagaccccgactcaataaataaataaggatggataaattgtagcgtatgcaccattcattatgctaagacattttaaagtaattatgagaaacgctctactaatgatttgtttttatttgtatttttctgcttattagacaaatatatactcattttaaaaaggcgtgtgtgtatataaagtgagagtgctctctatcccttctcttctgggatcctgattcctggcagcttggtgaatattctaccatattgccttttatttgcataaacccatttttcttttacaaaaacaggaacattctgttcacactactatgcaacctgctttcactgatcagcatgtgttagacatgttgacatgtccaatacacacacatcttccttgccctggaaacaccatccaccttcctttctgcgtgtagctgtcccggcatttatctcctggttcctctagtgacaggcatgggggatttctagtacatggctgttatccacagtaccacaatgaacattttttttttctt

SEQ ID NO: 335621 - DNA, 558 bp, Homo sapiens
catgcttccctgtgctattcaagtgctaataacatcagcatactgggtgccttcaggtctgttaccaaatggctctcctaaactcatcctttatgatttttctgtcagtgtctgtgcctctccccaacatatgagctggcgcttcaaacaggaaaagtgattgagcagatgggcaaattttacccagaactgaagcttgcctatgccgttcgaggcaataaatgtgagtacggcaggcgacaactgaacagtgagcagggtagggggttgggcgtttgaattttgaagatgcgatgaccgtattcaactttctaattcagtctgaccctggagcctaactgtgttgctctatttgaatctatttgaatacctgctaatttgttaacagtctttttcagtcttaaaataagattttcggttgattaaaggtagagttttgaatttagcgtccagagttctgggacctgctaccaaagagggattaacaggactgaggatggaaggttggggtcagctccctttctttaaaagtaagcaaaaccaggtacagtggctcac

SEQ ID NO: 335622 - DNA, 310 bp, Homo sapiens
tttaaaataatcatttattttacaatttaagcagctttttaacagcgtataaaaaaatgtatgaaagtaatttgtgctcaatggagaaaacctgggtaatatagagaagcacgaagggggaaatatgcctttcattcagaaagaacattttgacatgttactgagtttcaccaatttaagtttcatttctgttcttccttgatccagcccacagaatctgattgcccagtctcagtctggcactggtaaaacagctgcctttgtcttagccatgctcagccgagtggagccatcagacagatacccccag

SEQ ID NO: 335623 - DNA, 733 bp, Homo sapiens
cggtccgcgtgaggtgcattctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcggtcagtagctcagctcctggcgaggaggacgtagcaggggcccaagcgaaacctcccaaaagcacagggagctccccgggttggggaggcccctgggcaacgcgctcctgcagtttgctagggcagtcacttgcccttgatttgctcttagagctaaagagaccaatgtcgagctttttatctccatctgggctggttaaggacttcatcctttggtaaatccgccccactatgcatgctgtcattcctctattgacctcctcggtgacgattataaggaaagccaagtttagattctgattctctttttcattacgcgactgttcttcgcatgtttctgtactactctgtatttaacatttcttagatccatgcttaacgtggttggtagtttgtagctctttgcagaataacagattgacttttggatttaatacctcaatctactgcagatgttggaaggaggcactacaaattgtttcattgatgtgtaaagtaacggtttcatgtacttgttctttcagtaatgaatattcattcaactggaatgtaattacagcatacactgtggc

SEQ ID NO: 335624 - DNA, 599 bp, Homo sapiens
cagtgtctgtgcctctccccaacatatgagctggcgcttcaaacaggaaaagtgattgagcagatgggcaaattttacccagaactgaagcttgcctatgccgttcgaggcaataaatgtgagtacggcaggcgacaactgaacagtgagcagggtagggggttgggcgtttgaattttgaagatgcgatgaccgtattcaactttctaattcagtctgaccctggagcctaactgtgttgctctatttgaatctatttgaatacctgctaatttgttaacagtctttttcagtcttaaaataagattttcggttgattaaaaaaaaaaatccacgcatggctcacagagttcttaatatctagagttcttcgctcagaaggtagagttttgaatttagcgtccagagttctgggacctgctaccaaagagggattaacaggactgaggatggaaggttggggtcagctccctttctttaaaagtaagcaaaaccaggtacagtggctcacacctgcaatcccagccctttgggaggccagggtgggaggactgcttgagcacatggttcgagaccagcctgggcaacatagtaagaca

SEQ ID NO: 335625 - DNA, 2572 bp, Homo sapiens
ttttaagtcaattcacgcgagggcaggcgactagcagttctctcaaggacatagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaattggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggtagtcgctggccccaggaccccctcctgattttggctaggcatcgtggaaccagctccagcccctgaagaaacgatagatgtgcaggttgtgcggaagaggctgagtggaaaatggtgtgagccccaccgctgtgcatcgaatgagggaagtggcagcagagaggccagagctgccccctctctgtctcttcaatggacccttcacaagtgtttctcctgcccttggggctgtcttccttctcctgaaatccagagactttcttgctcatcccttctccctttcacttctgttctctgctgcagaaagcagacttgcatatccctgatgagcagctcggctacttttgtaaacttcagatttggagagaaacacgaaagtctgaatcctgaccccttgagagagagtgatctggcgagggccgatgaaggggctgggcctggtcttgccttctcttctctcggttgctccctctgcctaggcccctggtactcagtcacggcagccaggagaccccaggtgagtttctgagcgcatacgtagttggttcttacccccaggtgtcacacggggccgagagctgagcaagaatttggaatggaagttatgaccaagggaattatgctgttcatttataatagtggacattatggagagctctgattcctacataatatgaataaggatggataggccgggcgtggtggctcatgcctataatcccagcacgttgggaggctgaggcgggcggatcggttgagctcaggcgttcgggaccagcctggccaacatgatgaaaccccgtctctaccaaaaatagaaaaaaatatagccgggcctggtggcgcacgcctgtagtcccagctactcgggaggctgaggtaggaggatcgcttgagcctgggtagaggctgctgtgagctgaaatggcgccactgcactccagcctgggtaacagagcgagaccccgactcaataaataaataaggatggataaattgtagcgtatgcaccattcattatgctaagacattttaaagtaattatgagaaacgctctactaatgatttgtttttatttgtatttttctgcttattagacaaatatatactcattttaaaaagg

SEQ ID NO: 335626 - DNA, 2453 bp, Homo sapiens
catgcttccctgtgctattcaagtgctaataacatcagcatactgggtgccttcaggtctgttaccaaatggctctcctaaactcatcctttatgatttttctgtcagtgtctgtgcctctccccaacatatgagctggcgcttcaaacaggaaaagtgattgagcagatgggcaaattttacccagaactgaagcttgcctatgccgttcgaggcaataaattggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggtagtcgctggccccaggaccccctcctgattttggctaggcatcgtggaaccagctccagcccctgaagaaacgatagatgtgcaggttgtgcggaagaggctgagtggaaaatggtgtgagccccaccgctgtgcatcgaatgagggaagtggcagcagagaggccagagctgccccctctctgtctcttcaatggacccttcacaagtgtttctcctgcccttggggctgtcttccttctcctgaaatccagagactttcttgctcatcccttctccctttcacttctgttctctgctgcagaaagcagacttgcatatccctgatgagcagctcggctacttttgtaaacttcagatttggagagaaacacgaaagtctgaatcctgaccccttgagagagagtgatctggcgagggccgatgaaggggctgggcctggtcttgccttctcttctctcggttgctccctctgcctaggcccctggtactcagtcacggcagccaggagaccccaggtgagtttctgagcgcatacgtagttggttcttacccccaggtgtcacacggggccgagagctgagcaagaatttggaatggaagttatgaccaagggaattatgctgttcatttataatagtggacattatggagagctctgattcctacataatatgaataaggatggataggccgggcgtggtggctcatgcctataatcccagcacgttgggaggctgaggcgggcggatcggttgagctcaggcgttcgggaccagcctggccaacatgatgaaaccccgtctctaccaaaaatagaaaaaaatatagccgggcctggtggcgcacgcctgtagtcccagctactcgggaggctgaggtaggaggatcgcttgagcctgggtagaggctgctgtgagctgaaatggcgccactgcactccagcctgggtaacagagcgagaccccgactcaataaataaataaggatggataaattgtagcgtatgcaccattcattatgctaagacattttaaagtaattatgagaaacgctctactaatgatttgtttttatttgtatttttctgcttattagacaaatatatactcattttaaaaagg

SEQ ID NO: 335627 - DNA, 2534 bp, Homo sapiens
aaataaataaataaataaacataaaaagagttggatgatgttggattataggaggaagaagaagggaactgatgcttattgaaggattgctgtgtgggatttgatcctgaccacagtgcactgagataggtgtcattctgcccacttcacagcagaagagaccaagactgaggggaacactcatgtgtgttttgaaatctggaaataacttgttctcctagtcctagaaggatgggcagggctttgatttccagagctggctttgcctttgaaatacctatgaaaatcacctgggtctccacagtggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggtagtcgctggccccaggaccccctcctgattttggctaggcatcgtggaaccagctccagcccctgaagaaacgatagatgtgcaggttgtgcggaagaggctgagtggaaaatggtgtgagccccaccgctgtgcatcgaatgagggaagtggcagcagagaggccagagctgccccctctctgtctcttcaatggacccttcacaagtgtttctcctgcccttggggctgtcttccttctcctgaaatccagagactttcttgctcatcccttctccctttcacttctgttctctgctgcagaaagcagacttgcatatccctgatgagcagctcggctacttttgtaaacttcagatttggagagaaacacgaaagtctgaatcctgaccccttgagagagagtgatctggcgagggccgatgaaggggctgggcctggtcttgccttctcttctctcggttgctccctctgcctaggcccctggtactcagtcacggcagccaggagaccccaggtgagtttctgagcgcatacgtagttggttcttacccccaggtgtcacacggggccgagagctgagcaagaatttggaatggaagttatgaccaagggaattatgctgttcatttataatagtggacattatggagagctctgattcctacataatatgaataaggatggataggccgggcgtggtggctcatgcctataatcccagcacgttgggaggctgaggcgggcggatcggttgagctcaggcgttcgggaccagcctggccaacatgatgaaaccccgtctctaccaaaaatagaaaaaaatatagccgggcctggtggcgcacgcctgtagtcccagctactcgggaggctgaggtaggaggatcgcttgagcctgggtagaggctgctgtgagctgaaatggcgccactgcactccagcctgggtaacagagcgagaccccgactcaataaataaataaggatggataaattgtagcgtatgcaccattcattatgctaagacattttaaagtaattatgagaaacgctctactaatgatttgtttttatttgtatttttctgcttattagacaaatatatactcattttaaaaagg

SEQ ID NO: 335628 - DNA, 2360 bp, Homo sapiens
tcccttcacttcagacgcctcctctggcttctgcctgggtcttggctctcgtactctcagcagcatttgtttgacgggccatttccatgtcagcgctgatcacagtccctcccaacctgggttgagaaaggagacctagggactcttccccaacccttgtccccatcccaggcctgctgctcctcctccccaagatgctcctcccccatcagccttcctgggcatctagaccctcccagctggggaggctgtgcttccgttgcttcccagggccacctggggccatctacccgggccttcccttgcaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggtagtcgctggccccaggaccccctcctgattttggctaggcatcgtggaaccagctccagcccctgaagaaacgatagatgtgcaggttgtgcggaagaggctgagtggaaaatggtgtgagccccaccgctgtgcatcgaatgagggaagtggcagcagagaggccagagctgccccctctctgtctcttcaatggacccttcacaagtgtttctcctgcccttggggctgtcttccttctcctgaaatccagagactttcttgctcatcccttctccctttcacttctgttctctgctgcagaaagcagacttgcatatccctgatgagcagctcggctacttttgtaaacttcagatttggagagaaacacgaaagtctgaatcctgaccccttgagagagagtgatctggcgagggccgatgaaggggctgggcctggtcttgccttctcttctctcggttgctccctctgcctaggcccctggtactcagtcacggcagccaggagaccccaggtgagtttctgagcgcatacgtagttggttcttacccccaggtgtcacacggggccgagagctgagcaagaatttggaatggaagttatgaccaagggaattatgctgttcatttataatagtggacattatggagagctctgattcctacataatatgaataaggatggataggccgggcgtggtggctcatgcctataatcccagcacgttgggaggctgaggcgggcggatcggttgagctcaggcgttcgggaccagcctggccaacatgatgaaaccccgtctctaccaaaaatagaaaaaaatatagccgggcctggtggcgcacgcctgtagtcccagctactcgggaggctgaggtaggaggatcgcttgagcctgggtagaggctgctgtgagctgaaatggcgccactgcactccagcctgggtaacagagcgagaccccgactcaataaataaataaggatggataaattgtagcgtatgcaccattcattatgctaagacattttaaagtaattatgagaaacgctctactaatgatttgtttttatttgtatttttctgcttattagacaaatatatactcattttaaaaagg

SEQ ID NO: 335629 - DNA, 1617 bp, Homo sapiens
gtgctcaccgccgcttccggtccgcgtgaggtgcattctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctgaaaccacagcttctccagggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaattggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggtgagcagaggacgtgtcccacctggtctgccaggctcggggtcccaggcccaattagagccagaaatccttgtatacagggaagtcggatggtctcagggagatgggtggggttggtgacactattcctttctaggagagactgtttggatttccctgaggtggtaagaactcacacatgccaggtgcggtggctcatgcctgcaatcccaaggcaggaaaattgcttgaaccctggagacagaggttgcagtgagccgagaatgtgctatagcactccatcctgggtgacagagtgagactctgtctccaa

SEQ ID NO: 335630 - DNA, 1060 bp, Homo sapiens
gtgctcaccgccgcttccggtccgcgtgaggtgcattctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctgaaaccacagcttctccagggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaatgtgagtacggcaggcgacaactgaacagtgagcagggtagggggttgggcgtttgaattttgaagatgcgatgaccgtattcaactttctaattcagtctgaccctggagcctaactgtgttgctctatttgaatctatttgaatacctgctaatttgttaacagtctttttcagtcttaaaataagattttcggttgattaaaggtagagttttgaatttagcgtccagagttctgggacctgctaccaaagagggattaacaggactgaggatggaaggttggggtcagctccctttctttaaaagtaagcaaaaccaggtacagtggctcac

SEQ ID NO: 335631 - DNA, 477 bp, Homo sapiens
aggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatgtgagtagcagcggcagtggcaggcctggcccctccctctcagccagctccccacagggctcaggaggactggatgcccctgagcgccatggaaagaagggaagtgctttttgaagatgtaagagacaggctctcctttagtgggggtaatggtagtatcccaagggatacatagcctaaagatagagcccctgaactttatgtcttatttgtggatgatgtattgttgcacaaccc

SEQ ID NO: 335632 - DNA, 708 bp, Homo sapiens
aaataaaaaaataaataaaaataaaaaaaataaaaaaagcatatttttgaaaagttttcgggccaggcacagtggctcatgcctgcttccactttcccatctcctttgactttgaccttttgtatccctttttcacttattaggaccttttaaggacattgtgcccacctggatcacccaggagacgctccccaactcaaaatcattaactgaatcacacctgcaaagttgcaaagtccttttagctgtgtaaggcactgtattcacagatcctgggggcgaggacgtgggggtctagagacgcatatcttcgggggccatgatctgtctcctatattagggacatagcagaagtcccactgaccagatagaggagacttaatagagtgacgaagaaactgtaaaaagctaagtgggaactcaacatttttctgctcacagctctcaagggaaagaccaaagtcctccccggtggccttcaaggtattatatatcacccctctgacctcaactccccctcccctttgctcagtgggccccaaccacaccagccccttcctgctccctggacacctctaagccttttccggcctctgggtttgactttccctcctagacccatctgtccttggagtctcatctccgattccagctcaaatgtcatcttctctgagaggcccaccgcagtggccccacagagagagcgtc

SEQ ID NO: 335633 - DNA, 511 bp, Homo sapiens
atgctggcaggaagggctctctggcagccttatatgacttggctgtccttaaaaaaaaggttaaggaaaaagaggaaaagaagaagaagaaaataaaaacgatcaaatcagaggcagaggacctggccgagccgctaagcagtactgaaggggtcgcacctctctcacaggccccctctccgctggcaattcctgctatcaaggaagagccccttgaagacctcaagccttgccttggaatcaatgaaatatcttccagcttcttctctcttctattagagatcttgctgctggagagtcaggctagccttcctatgctagaggagcgagttttggattggcagtcatcgccagccagctccctcaacagctggttctctgcggcccccaactgggctgagttggtactaccagccctgcagtatcttgctggagaaagtcgagctgttccttccagtttctctccatttgttgaattcaaagagaaaacccagcagtggaagttgcttgg

SEQ ID NO: 335634 - DNA, 169 bp, Homo sapiens
ccagcataactattaatagcatccctttgactcacaagtatcctgattcaggtgataaattacatgatcacctcatccataggagatagtaagtgcctaagaagataaaaaacaaaacaccaacgacctagaactaacccaccagatcccttcattaactgattcttcc

SEQ ID NO: 335635 - DNA, 657 bp, Homo sapiens
caagtagaagaggatgatttctagctctctattggaatttcagattaatgtctacaaaactcactaaagtccttgtattgaataattctttacccaactgatagcagttaggcttcattttcaatgccattaactctgagagcaaacgacaggcttttggtctgccaatatattaaaagtgtgtttctgaggaaatttcaatgagtcattcgtttatataacaaatacttgttgagcatctactttctattgggtactgttatagggattagagataacagctgcaagcaagtaaaaggcccttgctttctcagagctttcattccaggaaggagagaaagagagtaaccacacacatcaatagatgaccaggctgttgtgaagacacaaaagccaaatgagttgagggagagactgggggttagacaagggtgtttagggaagcactctaaagtgaggtgacgtggagttaaaattctgaatgataaaaaaaatgaaccacctatgtgaccatttgaggatggaacattccagacagagaggaaggcagatacaaatattctaggatgggaaggagctcagaatgtctgagagaattgaagacaagctttgtgcttagagcagagcaagctactttgaggttagagagggagccag

SEQ ID NO: 335636 - DNA, 215 bp, Homo sapiens
aggaagaagggaaggaacacaccctcacaggctcttccctggctgcattcatgcactgtgtcccgcttctcagtggaaccagctatcagcaccatggacagaacccgggagattgggtcctcagagcaagtaaaatgattcaggagtgtctggccaaggcactaactacagagatttttatttcatgtgaataaacagttttctgtttgacttca

SEQ ID NO: 335637 - DNA, 611 bp, Homo sapiens
gaggatgtagcaaatggtaacctgcagaaaatgatcccaaattcagtttttcagagacttaaatgatgcctatgtgtttgggagacacgaagtggataacaggcaggaaataaaaagtcccactatagagtaaaaattaagtccatagcatgaactatgagattaacaatgtaaatttgtgtttttttgttttgttttgagacgagtctcgctctgtcatccaggctggagtgcagtggcacgatcttggctcactgcaacctccgtctcccaggttcaagcgattctcctgcctctgcctactgagtagctgggattacaggcacatgccaccacacccgactaatttgggtatctccagtagagaggggacttcaccaggtgggccaagctggtctcgaactcctgacctcaagtgatctgcctccttgacctggaaaagtgctgggatcacaggcatgagccaccacgcctgtccggttatgggatttttataagaaaattttactataattttcagataactttatgtcactgtcatccattacattttaatttttgaaactgatgtctttcccagaatttatgtactctataacggtgtgaatgat

SEQ ID NO: 335638 - DNA, 3034 bp, Homo sapiens
ctgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 335639 - DNA, 1570 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (10)..(10): n is a, c, g, or t
  misc_feature (13)..(13): n is a, c, g, or t
  misc_feature (30)..(30): n is a, c, g, or t
  misc_feature (39)..(39): n is a, c, g, or t
  misc_feature (42)..(43): n is a, c, g, or t
  misc_feature (47)..(47): n is a, c, g, or t
  misc_feature (73)..(74): n is a, c, g, or t
  misc_feature (79)..(79): n is a, c, g, or t
  misc_feature (83)..(83): n is a, c, g, or t
  misc_feature (87)..(87): n is a, c, g, or t
  misc_feature (114)..(115): n is a, c, g, or t
  misc_feature (184)..(184): n is a, c, g, or t
  misc_feature (281)..(281): n is a, c, g, or t
  misc_feature (325)..(325): n is a, c, g, or t
  misc_feature (355)..(355): n is a, c, g, or t
  misc_feature (1550)..(1550): n is a, c, g, or t
tngcnancanacngtgccctgtctctactnaaaatacanaannattngctggacatggtggtgggtgcctgtnntcccngctnctcnggaggctgaggcaggagaatgacatgnnccttggaggcggagcttgcagtgagcccagatggcgccactgtgctccagcctgggcgactgagcgagnctccgtctcaaaaaaaaaaaattctttcatttatttagttacttttagagatagagcctcccgctgttgcccaggctggagtgcagtggcagtcatngcttactgcagctttgaactcctgggctcaaatgatcctcctgnctcagcctctccagtagctgggactgactncaggcacgtgccaccacacccagctaatttttatttttatttttatttttttgagacagggttttactctgtcacccaggctagagtgcagtggtgagatcatggctcactgtagcctctgtctccggggctcaatcaatcctcccacctcagcctccccagtggctgggattactggtgcacaccaccataccctgctaattgtatttatttttagtagagatgggattttgccatgttgcccagactggtcttgagctgctgggctcaagcgatcttcccatcacagcttcccaatgtgctgggattacaggtgtgagccactgtacctggccagctttacttcttttaccagcactcctgattttataaatagtgaggcttatcaaccccatttctacccaaatcttctggtagacttgagtatagtagggcttcataggtagcagccctgtccctgtcctattatgatggtagctgttgtgatgtggcgatctctgatctagaaacccctgaggggccattgtggcctgcccagtctcccggccacggttgaaaccagacgtgcagtggggctgacccctgtgccccaccccagagtcatgccagcgtgggtggtggggcattctctgggatgaatgatctggatcccatagccatctgtgtcctgtttgaggaatgggaccctcaaacagagaacagccaagatgctcaagcagtggtttatctctagggtctccatagcaggggaggtagggtcagactcctgagatggctgatgtcctaccctgcccccaaccaggggccccaggagactcctttttcttactgcaactttggcctcctcagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcacnagggaaggaggggtaccgag

SEQ ID NO: 335640 - DNA, 678 bp, Homo sapiens
ctgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgagacggtctccttctgtcacccaggctggagtgtagtggaacgatcaccgctgaactgcagcgtcggcttcctgggctcaagcgatcctcccacctcaacctcccaagtcatggggactacagatgccatcacacctggctaatttttaaatttttctgtggagacagggtctcattctgttgcccaggcttgtctcgaaccctggtctaaagtgatcttcccgcctagcctcccaaaatgttggaattacaggtgtgagttattgcactgggctggtttctggttaatttattttttgaaacagggtctccagaagtacagcagcaagatctcagctcactgtagcctccacctacggggctcaagtgatcctcccaccttacatcccaggtagctgggactgcaggcacctgccaccacacccagctagtttttgt

SEQ ID NO: 335641 - DNA, 455 bp, Homo sapiens
gtactggaccgtcgtgctagatgaattctgcttcactatggcagaagcaggaaacaagctacaggagctgaacttgtcattctgtgaaatcaagagggatgctgccctggctgttgctgaggccatggcagacaaagctgagctggagaagctggacctgaatgcaacaccctggcagaagcaggaagcgcttcctgcttctgcctaggggttggtgattcttacgttgttgttccacaggttacagtgactcttcttctcatcctgctgttattcttcatgaattggcttctaggcaacccagtagtgtacatataccaaaagggctcacctcagccagcacaggaggcttcttgaagttctagtcctctttatgaaacatccactgaattgcttccaagactaggttaccactctaacaaggcactctgctatacattgcttcctgcttctgc

SEQ ID NO: 335642 - DNA, 3287 bp, Homo sapiens
ctgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgagacggtctccttctgtcacccaggctggagtgtagtggaacgatcaccgctgaactgcagcgtcggcttcctgggctcaagcgatcctcccacctcaacctcccaagtcatggggactacagatgccatcacacctggctaatttttaaatttttctgtggagacagggtctcattctgttgcccaggcttgtctcgaaccctggtctaaagtgatcttcccgcctagcctcccaaaatgttggaattacagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 335643 - DNA, 3472 bp, Homo sapiens
ttcctttccccgtcacctgcctggaacaggggtgcggggcgaggagggcgtggcgcccgtgtgcgccttctgcctgccccctcggccttcttcacttagccttcgacggccgagcgccccaggggtggcggtgggagtggggttgttgagcggcgctggctcctttcacaaatggggaaactgaggcttaaagggcgtctgactcgccagagcagctcagcctgcagctgctagcagtggcgtctcatattagcattgttgtcaaccggaggcggtgcgagtccgccggggattccagatggggctcctgcgccgcccgcctatcatttgcggcctgtattcgcgcgtcgctcccgcagagccacctcccagcaggcccacgcccgcgggggccccgggctggcgccgctgtccctggaatcgatagacggtctccttctgtcacccaggctggagtgtagtggaacgatcaccgctgaactgcagcgtcggcttcctgggctcaagcgatcctcccacctcaacctcccaagtcatggggactacagatgccatcacacctggctaatttttaaatttttctgtggagacagggtctcattctgttgcccaggcttgtctcgaaccctggtctaaagtgatcttcccgcctagcctcccaaaatgttggaattacagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 335644 - DNA, 3165 bp, Homo sapiens
ctgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttcaaaaaaaaaaaatcccaaaaaacccctcggggcctccttattcggggggccgccaaaccgccgttttgcaattggccctgggcctcaccctttttcccgtgccccctttttttgttcccaccggggccactc

SEQ ID NO: 335645 - DNA, 3278 bp, Homo sapiens
  misc_feature (3050)..(3051): n is a, c, g, or t
  misc_feature (3054)..(3054): n is a, c, g, or t
ctgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttcaaaaacaaaaaaaaatnnatnaataaaaaaatataaatttttttttattataattatattttttttatttttttattttttaaaaaaaaaaaaaaactctaggggggcccgggcacccaattccccctatggggagctttttaaaataaatggccggcgtttacaacttctgaatgggaaaaccttggtttaccaacttaatggcttttgggtcaaacaattgccccctgaatgggaatgggaaa

SEQ ID NO: 335646 - DNA, 2899 bp, Homo sapiens
ctgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaaggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 335647 - DNA, 2501 bp, Homo sapiens
aaacctctcaggctggtgtgacacagcattagagataaaaaccttgtgtaactgaagtgctggacatatttaaggtgtgactgttgagctgttagcagtcctgcgtcccctgacctgcaccgatgggtggcgtgggatgttgaagagcagttcagcagcagtggccaccccgctgggagaaggggctcctgcccatgaccagggccccttgcctttccccacagaatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 335648 - DNA, 2767 bp, Homo sapiens
ctgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttcaaaaaaaaaaaaaaaaaaaaaaaaaaaaacc

SEQ ID NO: 335649 - DNA, 1402 bp, Homo sapiens
ggacgcgtgggtcgacccacgcgtcgactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 335650 - DNA, 1473 bp, Homo sapiens
actccgtctcaaaaaaaaaagaaaaagaaaaagaaaaaaagcaaccaaaaaaacaatggctagccatttacttatgatccagattggactctagtgggccagtcctatgtggccactggcagccagtaaggattccctggcctatgtctgctggaagggcccttggagagcctggctgagggggccttcattctggccagctctgggctgtgtggcgttgggtgcctggctctctgagcctctcgcacctcccatccccacccacggtgtgcagaaggcagagggctaatgtctctcttgctgagtcgttgtgcaaattaacaaaaatgagtctggcaccaaaatggcccccacacttggaaaacaggccaagaggcatccaccgacctgctgacccctctttccccgcaggcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 335651 - DNA, 1810 bp, Homo sapiens
ctgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 335652 - DNA, 1214 bp, Homo sapiens
gacggcagtgcaccgtgatgccgtgatggccactctagagggccccggacagcacgcgctaacaaaaatgagtctggcaccaaaatggcccccacacttggaaaacaggccaagaggcatccaccgacctgctgacccctctttccccgcaggcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 335653 - DNA, 1102 bp, Homo sapiens
  misc_feature (9)..(9): n is a, c, g, or t
  misc_feature (11)..(11): n is a, c, g, or t
  misc_feature (39)..(39): n is a, c, g, or t
tccccaagncncttgccccctgctgtggcgttcgtgacnagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 335654 - DNA, 2031 bp, Homo sapiens
ctgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactattctccctgagcacccgtgactgccccatgctttcccctttgtgctctgtgtgtgtctgggctgtgcccgggggcttcacaaataaagtcgtgtggcagcttca

SEQ ID NO: 335655 - DNA, 1691 bp, Homo sapiens
ctgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctcttcctcctcttcctcatcttcctcctcctcttcttctgcttcctcttcttcctcttctccttcctcctcctcctcctcgtcctcgtcatcactgagggacgccagcaccttgccatgta

SEQ ID NO: 335656 - DNA, 606 bp, Homo sapiens
  misc_feature (586)..(586): n is a, c, g, or t
ctgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcacnagggaaggaggggtaccgag

SEQ ID NO: 335657 - DNA, 1253 bp, Homo sapiens
ttcctttccccgtcacctgcctggaacaggggtgcggggcgaggagggcgtggcgcccgtgtgcgccttctgcctgccccctcggccttcttcacttagccttcgacggccgagcgccccaggggtggcggtgggagtggggttgttgagcggcgctggctcctttcacaaatggggaaactgaggcttaaagggcgtctgactcgccagagcagctcagcctgcagctgctagcagtggcgtctcatattagcattgttgtcaaccggaggcggtgcgagtccgccggggattccagatggggctcctgcgccgcccgcctatcatttgcggcctgtattcgcgcgtcgctcccgcagagccacctcccagcaggcccacgcccgcgggggccccgggctggcgccgctgtccctggaatcgatgtgagtcactgctgacgctttgcaggagcatgcatctcacctcagaaagtctctgacgttgctgcggagcggggagaggatgtttctctattagccctttgcttttgctctggcgctgatcctttgctgaccttggacaaatcaatttacgtttctgtgctccagtttcttggtttataaagtgagtgtggaggggtgcatctctgtctcgctctctcttggactgaggaatgggcccccgttcagctgagaagttctgtccctattctatctggaggcttcaccaccaccttttaccctcaaattgtcccatctcagaactgcaagagatgctggggtttcaggttaatttttttgttggtttttctttaaatttttttatctttttagagacggtctccttctgtcacccaggctggagtgtagtggaacgatcaccgctgaactgcagcgtcggcttcctgggctcaagcgatcctcccacctcaacctcccaagtcatggggactacagatgccatcacacctggctaatttttaaatttttctgtggagacagggtctcattctgttgcccaggcttgtctcgaaccctggtctaaagtgatcttcccgcctagcctcccaaaatgttggaattacaggtgtgagttattgcactgggctggtttctggttaatttattttttgaaacagggtctccagaagtacagcagcaagatctcagctcactgtagcctccacctacggggctcaagtgatcctcccaccttacatcccaggtagctgggactgcaggcacctgccaccacacccagctagtttttgt

SEQ ID NO: 335658 - DNA, 4241 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (10)..(10): n is a, c, g, or t
  misc_feature (13)..(13): n is a, c, g, or t
  misc_feature (30)..(30): n is a, c, g, or t
  misc_feature (39)..(39): n is a, c, g, or t
  misc_feature (42)..(43): n is a, c, g, or t
  misc_feature (47)..(47): n is a, c, g, or t
  misc_feature (73)..(74): n is a, c, g, or t
  misc_feature (79)..(79): n is a, c, g, or t
  misc_feature (83)..(83): n is a, c, g, or t
  misc_feature (87)..(87): n is a, c, g, or t
  misc_feature (114)..(115): n is a, c, g, or t
  misc_feature (184)..(184): n is a, c, g, or t
  misc_feature (281)..(281): n is a, c, g, or t
  misc_feature (325)..(325): n is a, c, g, or t
  misc_feature (355)..(355): n is a, c, g, or t
tngcnancanacngtgccctgtctctactnaaaatacanaannattngctggacatggtggtgggtgcctgtnntcccngctnctcnggaggctgaggcaggagaatgacatgnnccttggaggcggagcttgcagtgagcccagatggcgccactgtgctccagcctgggcgactgagcgagnctccgtctcaaaaaaaaaaaattctttcatttatttagttacttttagagatagagcctcccgctgttgcccaggctggagtgcagtggcagtcatngcttactgcagctttgaactcctgggctcaaatgatcctcctgnctcagcctctccagtagctgggactgactncaggcacgtgccaccacacccagctaatttttatttttatttttatttttttgagacagggttttactctgtcacccaggctagagtgcagtggtgagatcatggctcactgtagcctctgtctccggggctcaatcaatcctcccacctcagcctccccagtggctgggattactggtgcacaccaccataccctgctaattgtatttatttttagtagagatgggattttgccatgttgcccagactggtcttgagctgctgggctcaagcgatcttcccatcacagcttcccaatgtgctgggattacaggtgtgagccactgtacctggccagctttacttcttttaccagcactcctgattttataaatagtgaggcttatcaaccccatttctacccaaatcttctggtagacttgagtatagtagggcttcataggtagcagccctgtccctgtcctattatgatggtagctgttgtgatgtggcgatctctgatctagaaacccctgaggggccattgtggcctgcccagtctcccggccacggttgaaaccagacgtgcagtggggctgacccctgtgccccaccccagagtcatgccagcgtgggtggtggggcattctctgggatgaatgatctggatcccatagccatctgtgtcctgtttgaggaatgggaccctcaaacagagaacagccaagatgctcaagcaggtgtgtgcttgggccagactctgcagcctttggtttgggacttgactgccattcactgaaggggcccaggaaatgggcagctcacatggtgttgctgggtgtccagctgcggcagtttagcagaggaggacttgtaatgagatggtagcttcttataggctaagacatgatttttctgttcttttactacctcctgcaccttctagaactgttccttcctgatgctgttttcctttcttccagtggtttatctctagggtctccatagcaggggaggtagggtcagactcctgagatggctgatgtcctaccctgcccccaaccaggggccccaggagactcctttttcttactgcaactttggcctcctcagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 335659 - DNA, 573 bp, Homo sapiens
tgcacacgccgaacgaccatacaggtcacaatggacgaagttgttgcccgagtgtccacaccacatgagctaagtctgggcattcggcgtgtgcagtatggaggctcggcgtgtgcatgcacacgccgagtgtccacaccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtatgatattccgcgtgtgctgcacacgcccgaataaccagactgagccaatccgactggacgcagctgttggcagatcctcctagaac

SEQ ID NO: 335660 - DNA, 3219 bp, Homo sapiens
ttcctttccccgtcacctgcctggaacaggggtgcggggcgaggagggcgtggcgcccgtgtgcgccttctgcctgccccctcggccttcttcacttagccttcgacggccgagcgccccaggggtggcggtgggagtggggttgttgagcggcgctggctcctttcacaaatggggaaactgaggcttaaagggcgtctgactcgccagagcagctcagcctgcagctgctagcagtggcgtctcatattagcattgttgtcaaccggaggcggtgcgagtccgccggggattccagatggggctcctgcgccgcccgcctatcatttgcggcctgtattcgcgcgtcgctcccgcagagccacctcccagcaggcccacgcccgcgggggccccgggctggcgccgctgtccctggaatcgattctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 335661 - DNA, 3862 bp, Homo sapiens
ttcctttccccgtcacctgcctggaacaggggtgcggggcgaggagggcgtggcgcccgtgtgcgccttctgcctgccccctcggccttcttcacttagccttcgacggccgagcgccccaggggtggcggtgggagtggggttgttgagcggcgctggctcctttcacaaatggggaaactgaggcttaaagggcgtctgactcgccagagcagctcagcctgcagctgctagcagtggcgtctcatattagcattgttgtcaaccggaggcggtgcgagtccgccggggattccagatggggctcctgcgccgcccgcctatcatttgcggcctgtattcgcgcgtcgctcccgcagagccacctcccagcaggcccacgcccgcgggggccccgggctggcgccgctgtccctggaatcgatgtgagtcactgctgacgctttgcaggagcatgcatctcacctcagaaagtctctgacgttgctgcggagcggggagaggatgtttctctattagccctttgcttttgctctggcgctgatcctttgctgaccttggacaaatcaatttacgtttctgtgctccagtttcttggtttataaagtgagtgtggaggggtgcatctctgtctcgctctctcttggactgaggaatgggcccccgttcagctgagaagttctgtccctattctatctggaggcttcaccaccaccttttaccctcaaattgtcccatctcagaactgcaagagatgctggggtttcaggttaatttttttgttggtttttctttaaatttttttatctttttagagacggtctccttctgtcacccaggctggagtgtagtggaacgatcaccgctgaactgcagcgtcggcttcctgggctcaagcgatcctcccacctcaacctcccaagtcatggggactacagatgccatcacacctggctaatttttaaatttttctgtggagacagggtctcattctgttgcccaggcttgtctcgaaccctggtctaaagtgatcttcccgcctagcctcccaaaatgttggaattacagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 335662 - DNA, 4123 bp, Homo sapiens
ctgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttcaactcagaaactctcactgaaagcgggatagtctcgggggccgttgtacgtggagtcccacctcggcagagcatgcggccccgcagcagtctgtggggcagtcagccctgcagaagggcccggcctcggcctcaggccactacctgggaagtggcagtcctgagtgggggcccattttcctgcctggccacacctcacccagcaccctgcctttgggctgcagctcgcttggcttctgcgttgctccttcactatggaagccacctcccttgggatcctttgctccactgccacatatgtgaggacagcccagccaaccttccttacctcctaccctacaccatgtatgtgctttgggagcccatgtcccccacaaacggcctccaagaagtccctccaaggtttcttagagggcaatattttctcattggcagtcggccacgtaggtgaccaggtggcagaggatactgctggccctgtcccctgtcttctgtgtgagttgatacggtagggggtgggtgtggggctggcattaagttctgatgccagctacaacgtggatgaactttgaaaacatgttaaatgaaataagccagacacaaaaggacaaatatgattccatttagatgaggcatctagaataagcaaattcagagaccaagaaggtagaggttgccagggctaggggaagggtggaatagggagtgaggctgcaaacagattctctgggatgatgaagatgttctggaaatggagagtggtggtggttgcataacattgtgaatgtacttaatgcactgaattgtacacataaaaatggttaaaatgatagatttcatgtattaatatattttacctcagctcacttaacaggcatgaaccaccatgcccggctacagtgctctttctaataaacccatgctggaaacaacccaaatgtctatcactagaggaatgggtaagctacttgtggtacggtgtggtaccgagaaggtaggaatggtctgcccaagaagaaatattttagcattgacattgtttagacttgtcagcacatgataataaaaagcagagaccaactttaagtcag

SEQ ID NO: 335663 - DNA, 2964 bp, Homo sapiens
ctgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 335664 - DNA, 2960 bp, Homo sapiens
ctgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 335665 - DNA, 1660 bp, Homo sapiens
ggacgcgtgggtcgacccacgcgtcggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 335666 - DNA, 2328 bp, Homo sapiens
ctgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 335667 - DNA, 2253 bp, Homo sapiens
ctgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 335668 - DNA, 1699 bp, Homo sapiens
ctgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggtgaggatacagcaagaaagcagccatctataaaccaggaaggcggccctcaccaacaacctgaccatgctgggaccctggtcgtggacttccagcccccagatcagtgagaaataaatttctactgcttaaaaaaaaaaaaaaaaaaaaaaaaaaaaacc

SEQ ID NO: 335669 - DNA, 1856 bp, Homo sapiens
gttctagaggatccctcaagctgctcacagaagattcggacctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttcaactcagaaactctcactgaaagcgggatagtctcgggggccgttgtacgtggagtcccacctcggcagagcatgcggccccgcagcagtctgtggggcagtcagccctgcagaagggcccggcctcggcctcaggccactacctgggaagtggcagtcctgagtgggggcccattttcctgcctggccacacctcacccagcaccctgcctttgggctgcagctcgcttggcttctgcgttgctccttcactatggaagccacctcccttgggatcctttgctccactgccacatatgtgaggacagcccagccaaccttccttacctcctaccctacaccatgtatgtgctttgggagcccatgtcccccacaaacggcctccaagaagtccctccaaggtttcttagagggcaatattttctcattggcagtcggccacgtaggtgaccaggtggcagaggatactgctggccctgtcccctgtcttctgtgtgagttgatacggtagggggtgggtgtggggctggcattaagttctgatgccagctacaacgtggatgaactttgaaaacatgttaaatgaaataagccagacacaaaaggacaaatatgattccatttagatgaggcatctagaataagcaaattcagagaccaagaaggtagaggttgccagggctaggggaagggtggaatagggagtgaggctgcaaacagattctctgggatgatgaagatgttctggaaatggagagtggtggtggttgcataacattgtgaatgtacttaatgcactgaattgtacacataaaaatggttaaaatgatagatttcatgtattaatatattttacctcagctcacttaacaggcatgaaccaccatgcccggctacagtgctctttctaataaacccatgctggaaacaacccaaatgtctatcactagaggaatgggtaagctacttgtggtacggtgtggtaccgagaaggtaggaatggtctgcccaagaagaaatattttagcattgacattgtttagacttgtcagcacatgataataaaaagcagagaccaactttaagtcag

SEQ ID NO: 335670 - DNA, 896 bp, Homo sapiens
ccgtgcgtcccttgtcccccggtccggcccccttctcgtcgtacatgttcgggggctctaccgcttgagtctgtcgtagcgcccgagtttggacccctgggacgcaactgcttggcggggccccgggtaactggccagttgttaatctgactatgtgggaacaccctcagtgagagatgcctgtatttatgaaggaagaatataaaatctgttaaaaacttaaaacatctaaaataggtatgaagagaggcttatggtgctcattttaacagcattcttgagtaggttaccttgcagtcaaagcatctgctccagaccagtgttttaaactgtggattatggtaccactatgggtcatgaaattaatttattgcattatgactagcattttttatttaaaatagagaaaagaatagaaaataaaagcgtacatcacagatggtaagggtatgtgtttttaagtaaacatttgttcatgtgtatatgtgttagattaccttgtaaaacatattccttattgtgggttacaggccaaaaaaagtgtttgtttttgtttttaaaaatctacagttcagattttccttagaaaatggggaaaaaaggaatgttagaaagatctgactgcctatgaactagtgaaggattttagaggaagtaccaggctattttagagatctgatactggtttcagaaaggtaatcttaaggcaaagggtaggaaataaagttatgttgttagtagaaatgtcaaatacggttaaagttgtgaggaggaattattttcctagtggacctacatttgttgtgtgtagatctgtgactattactgatctgttgtagcacattttccaatctaaaatgtccgatacagcacaataataaacatggggcagaata

SEQ ID NO: 335671 - DNA, 747 bp, Homo sapiens
tgtagattttattatccatgccatctatttataatcctatgacactcctatattgtttatggtttttttgtttttttttgtttttttttttagacgaagtcttgctctgtcacccaggctggagtgcagtggtgcaatctcggctcactgcaagctccgcctcccggttcacgccatgcttctgcctcagcctccccagtacctgggactacaggcgcccaccaccacgcccggctaattttttgtacttttagtagagatggggtttcaccgtgttagccaggatggtctccatctcctgacctcgtgatcccccggcctcggcctcccaaagtgttgggattacaggcgtgagccactgtgcctggccttactgtttatgttttcatgcatctataccttatgttactaaatcaaagtgaccagttccacattatactacaagtttcactgtgtaatgcataagaattacacagagggaagggcctcaaaaaatgcacttctgaagtattttaatgtaaaattatttaagaccataaagtttcatgaaagcctaatctttctggaacctacacatactctgcatgtgaaccagagttaaactagtcaagtattttaatactgaactaatctggaaaaacatcatttaaaaaattactgtatttatgaaggaagaatataaaatctgttaaaaacttaaaacatctaaaatagtccgcatccaagacggatcctctagccaccacc

SEQ ID NO: 335672 - DNA, 345 bp, Homo sapiens
  misc_feature (265)..(265): n is a, c, g, or t
actaatacttcctcaacgcttcatctttctcaacgcttatcttcctcaacgctttatacttcggaagggcctcaaaaaatgcacttctgaagtattttaatgtaaaattatttaagaccataaagtttcatgaaagcctaatctttctggaacctacacatactctgcatgtgaaccagagttaaactagtcaagtattttaatactgaactaatctggaaaaacatcatttaaaaaattactgtatttatgaaggaagaataangcgttgagaaagtataaagcgttgaggaagtataaagcgttgagaaagtataaagcgttgaggaagtataaagcgttgag

SEQ ID NO: 335673 - DNA, 1373 bp, Homo sapiens
tgtagattttattatccatgccatctatttataatcctatgacactcctatattgtttatggtttttttgtttttttttgtttttttttttagacgaagtcttgctctgtcacccaggctggagtgcagtggtgcaatctcggctcactgcaagctccgcctcccggttcacgccatgcttctgcctcagcctccccagtacctgggactacaggcgcccaccaccacgcccggctaattttttgtacttttagtagagatggggtttcaccgtgttagccaggatggtctccatctcctgacctcgtgatcccccggcctcggcctcccaaagtgttgggattacaggcgtgagccactgtgcctggccttactgtttatgttttcatgcatctataccttatgttactaaatcaaagtgaccagttccacattatactacaagtttcactgtgtaatgcataagaattacacagagggaagggcctcaaaaaatgcacttctgaagtattttaatgtaaaattatttaagaccataaagtttcatgaaagcctaatctttctggaacctacacatactctgcatgtgaaccagagttaaactagtcaagtattttaatactgaactaatctggaaaaacatcatttaaaaaattactgtatttatgaaggaagaatataaaatctgttaaaaacttaaaacatctaaaataggtatgaagagaggcttatggtgctcattttaacagcattcttgagtaggttaccttgcagtcaaagcatctgctccagaccagtgttttaaactgtggattatggtaccactatgggtcatgaaattaatttattgcattatgactagcattttttatttaaaatagagaaaagaatagaaaataaaagcgtacatcacagatggtaagggtatgtgtttttaagtaaacatttgttcatgtgtatatgtgttagattaccttgtaaaacatattccttattgtgggttacaggccaaaaaaagtgtttgtttttgtttttaaaaatctacagttcagattttccttagaaaatggggaaaaaaggaatgttagaaagatctgactgcctatgaactagtgaaggattttagaggaagtaccaggctattttagagatctgatactggtttcagaaaggtaatcttaaggcaaagggtaggaaataaagttatgttgttagtagaaatgtcaaatacggttaaagttgtgaggaggaattattttcctagtggacctacatttgttgtgtgtagatctgtgactattactgatctgttgtagcacattttccaatctaaaatgtccgatacagcacaataataaacatggggcagaata

SEQ ID NO: 335674 - DNA, 1606 bp, Homo sapiens
tgtagattttattatccatgccatctatttataatcctatgacactcctatattgtttatggtttttttgtttttttttgtttttttttttagacgaagtcttgctctgtcacccaggctggagtgcagtggtgcaatctcggctcactgcaagctccgcctcccggttcacgccatgcttctgcctcagcctccccagtacctgggactacaggcgcccaccaccacgcccggctaattttttgtacttttagtagagatggggtttcaccgtgttagccaggatggtctccatctcctgacctcgtgatcccccggcctcggcctcccaaagtgttgggattacaggcgtgagccactgtgcctggccttactgtttatgttttcatgcatctataccttatgttactaaatcaaagtgaccagttccacattatactacaagtttcactgtgtaatgcataagaattacacagagggaagggcctcaaaaaatgcacttctgaagtattttaatgtaaaattatttaagaccataaagtttcatgaaagcctaatctttctggaacctacacatactctgcatgtgaaccagagttaaactagtcaagtattttaatactgaactaatctggaaaaacatcatttaaaaaattactgtatttatgaaggaagaatataaaatctgttaaaaacttaaaacatctaaaataggtatgaagagaggcttatggtgctcattttaacagcattcttgagtaggttaccttgcagtcaaagcatctgctccagaccagtgttttaaactgtggattatggtaccactatgggtcatgaaattaatttattgcattatgactagcattttttatttaaaatagagaaaagaatagaaaataaaagcgtacatcacagatggtaagggtatgtgtttttaagtaaacatttgttcatgtgtatatgtgttagattaccttgtaaaacatattccttattgtgggttacaggccaaaaaaagtgtttgtttttgtttttaaaaatctacagttcagattttccttagaaaatggggaaaaaaggaatgttagaaagatctgactgcctatgaactagtgaaggattttagaggaagtaccaggctattttagagatctgatactggtttcagaaaggtaatcttaaggcaaagggtaggaaataaagttatgttgttagtagaaatgtcaaatacggttaaagttgtgaggaggaattattttcctagtggacctacatttgttgtgtgtagatctgtgactattactgatctgttgtagcacattttccaatctaaaatgtccgatacagcacaataataaacatggggcagaatatatgtttgtttctatttcttcccaccttcccttcaatcttaaaacaagtgtttattaataagtcagaccaaagcaaatttctatctttcacagagtaattatcataggaacaaattactccctgaaaatggtggaaacttctttctccctccgaaaaataaactttcaataagtgttttctctctagccaaagtaaataagttcttaaataggtaacgctcgtcgtgccatcc

SEQ ID NO: 335675 - DNA, 947 bp, Homo sapiens
tgtagattttattatccatgccatctatttataatcctatgacactcctatattgtttatggtttttttgtttttttttgtttttttttttagacgaagtcttgctctgtcacccaggctggagtgcagtggtgcaatctcggctcactgcaagctccgcctcccggttcacgccatgcttctgcctcagcctccccagtacctgggactacaggcgcccaccaccacgcccggctaattttttgtacttttagtagagatggggtttcaccgtgttagccaggatggtctccatctcctgacctcgtgatcccccggcctcggcctcccaaagtgttgggattacaggcgtgagccactgtgcctggccttactgtttatgttttcatgcatctataccttatgttactaaatcaaagtgaccagttccacattatactacaagtttcactgtgtaatgcataagaattacacagagggaagggcctcaaaaaatgcacttctgaagtattttaatgtaaaattatttaagaccataaagtttcatgaaagcctaatctttctggaacctacacatactctgcatgtgaaccagagttaaactagtcaagtattttaatactgaactaatctggaaaaacatcatttaaaaaattactgtatttatgaaggaagaatataaaatctgttaaaaacttaaaacatctaaaataggtatgaagagaggcttatggtgctcattttaacagcattcttgagtaggttaccttgcagtcaaagcatctgctccagaccagtgttttaaactgtggattatggtaccactatgggtcatgaaattaatttattgcattatgactagcattttttatttaaaatagagaaaagaatagaaaataaaagcgtccgtaagggttttccaagtcagagaccggcaagtggcaggc

SEQ ID NO: 335676 - DNA, 375 bp, Homo sapiens
ccctccgctatgagtccccagctctgtgcatcccttgcctccccatcagagcagtttccattcctcactcagccctctcgtggattgcaaaggctcttccagacagaggaggcctccttcattgtgcttcccccgagctaaccacacagatttccttaccacgatccctccccctccagaaatgctagccgaactgaggcaaggaaacaatcagagcagatcccgagagggtctcgggagaaacagggtacggcactgtttctgctgctcccaacatgtcccccagccaaggagcttttacagcctcctggggtgtgacatgatttaagaaggcctcaaggttccagtctgggatacaaaaagctgtaaatgaac

SEQ ID NO: 335677 - DNA, 165 bp, Homo sapiens
tgagatcatgccactgcactctagcctgggcatcacagcaaagaaaaagtaaaaagacaacccagtgagtggaaaaaaatatttgcaaatcacatcggaaatagccaaacaatcatgaaaaagaacaaagctggaagattcacactttctgatttcaaaacttac

SEQ ID NO: 335678 - DNA, 239 bp, Homo sapiens
acagaatcacagcagccacccatgttcatgaggccagcagcagatcccacgccattttcacgatccactacacgcaggcaatcctggagaacaacctcccttctgaaatggctagcaagatcaaccttgtggacctagcaggcagcgaaagagcagatcccagttactgtaaggaccgcattgctgaaggagccaatatcaacaagtcccttgtgactctaggaattgtcatctccacc

SEQ ID NO: 335679 - DNA, 571 bp, Homo sapiens
ccatagacacctagagaataataaatgtttattgttttaggacactaaattttgagaaaatgtgttacacagcactaagtagctaacaaagttgcattttgctagactgctttggtatctagaaatggagtctatcaatagtttataggttagaggtgccagtcctcatgttttcaggtttgagaaacactgctctaagctacaagataagccaacatgtcctagggctccaccaagggagagagagggctgtaagacagtaaagcactgccactgctggcatgactccatgtgcacagccagaaggcagagaacagtacaggtctaattcagggaaacagtgttgacatgcctgccctatatgaccttaagccccaggaaggcttgccgctcagagtcttgctgcatctgtgtaaaattaagctgcctaatactacataccgtgcacgtgcttaaactagagcagccagacagtgcttggcaggaatctgttttgttcccccctatataccagaaatactaactaaagaaacatcatggggccggggagaaaaaaacagaaaggatgaca

SEQ ID NO: 335680 - DNA, 940 bp, Homo sapiens
  misc_feature (503)..(503): n is a, c, g, or t
  misc_feature (580)..(580): n is a, c, g, or t
  misc_feature (599)..(599): n is a, c, g, or t
  misc_feature (604)..(604): n is a, c, g, or t
  misc_feature (615)..(615): n is a, c, g, or t
  misc_feature (636)..(636): n is a, c, g, or t
  misc_feature (651)..(651): n is a, c, g, or t
tctgcacctcactcactctgttccagccacacgggccttctcgctgtcctgtcctgaagatacccatgcaagctctcaccacaggccactgacccaaccactgtcttggcagcgctgcccagacaaccacatggcttgctcgcacacctcctgaatacctcacttcagtgagaccttccctcatcacaatatatttaaaattgcaaaatttcctctctctactccctgcaaagcatccactttcctctgcttctccaaagcactaattacctaaaaggacacacaagtttgcctaccacatagcagcagcccaataaatatttgttaaatgtagttaagagtattattagtgagcctaaggcaaaaattcaagattccaattctaggccggcgcagtggctcacatctgcaatcctaacacttcaggaggttaaggcaggaggatcgcttgagtctgggaggtcaaggctgcagtgagctgagactgggccactgcactccancctgggtgacagaacgagaccctgtctcaaaaaacaaaacaaaagacacacaaaaaagtgatgctagggaggccttnggcagagaatggatttccntaatngtgaatgtggnggtggtgcttctggaaatggnaatcaacagcacttngtggaggggcttttgcacagaatacatatatgaaccataaagaagtcccatttcccctccctaggttctcttcatacaagaaatggtagttagctccatggtttcctctgaatactttcctttgttgtctttcttgaaggactggcacaactcctgtccagctgctctatccagggtcccgattcagcaatgtcaaatctctccagctactttgcagattcgggatacgacagctcgtcaggatagatcacatcccagatctcccatgcatagtacatggggtcgcggg

SEQ ID NO: 335681 - DNA, 596 bp, Homo sapiens
ggaccgcctcagccctgcttgttgctagactctgattctgatatagatgcaatgaatatttgttgaatagatgaataacttatctcatgatgttgacagagacctttgaaatacgcctttcattaaccttataccaaatgatgccaagccagcatacctttatccttttagtaagtcttggcttgaatttcatccacattcttcctcattcaacaagaattactacatctttataatctgcccaaggatcaagcttaagaatagaaagagattttgtgcttaagtttcctgaccacttcgccatgcaaggagggcctctctcatcagtagctgttctgagtgagccgagatcatgccactgcactccagcctggatgacagagcaagactccatctcaaaaaagaagaaaggaatactataaggggaaaaaaattaagcagtaactacttaaaacccagaaatttttggtaatagtgataatacttaatcaaaattggacagttattttacaatttaacaattcattttacagtcaaaacagtgttatgatagaagtaggatgagttttactgttatccactgttaaaaaaataaa

SEQ ID NO: 335682 - DNA, 345 bp, Homo sapiens
atactaaatgaacatgatgcaaaatgaacaacacataagtttctgagagaaaagtcctcatgctgagaaagttaagaaatccttagtaacacggggttctgagtgaagaattactaaaggagattctagaaatccttggtagaatctgaactgtcaaaggactaaattgaacaattactgctctcccactattgcaaagccatttcctatagttgctgccacaagctagaacttcatcctgggcatgattcaacccctaatttgcaaatttataacagctcttggctactaagcatggttttcttctatagaccatacttcaataaaatactgttacaaataaca

SEQ ID NO: 335683 - DNA, 436 bp, Homo sapiens
tcaggtaaaaagcatgtcagtgggagagcgagggctgggagggctcctttactacctaaagataaatgttcatcagtgtgtgtatagatgaagtacttggatgaatgattttatttttttcggagggaggcttgtcatgattaacaaattcagtctaaattcgcttgctgaattcctaaccagttaaccctcaacattgaatttactcaaagtcatcctagagccagcatggtatagggtgtgtgtggtatagggtatatgtttgggctaggaaaaaaataatggagtgtcaggaagataaaaatccacaagataggccgggcacagtggctcacgcctgtaatcccagtgttttgggaagccgaggcaggtggatcacctaaggtcaggagtgtgagactagcctggccaatatggtgaaaccccatctctacta

SEQ ID NO: 335684 - DNA, 264 bp, Homo sapiens
catggggtgtgtgcaggtgtgtgtgtgcatgtgtgcccaggtgtttgagcatgtagatgggtgcacgtgtggggtatgtgcatggggtgtgtgcacgtgtgtgtgtgcgcccaggtgtatgagcgtgtggatgggtgcacgtatagaagtgcgcgtgggagaagtgcgcctgggtgcagaagtgcgcctgggtgcagaagtgcgcctgggtgcagaagtgcgcctgggtgcagaagtgcgcctgggtgcagaagcgcctgggtg

SEQ ID NO: 335685 - DNA, 523 bp, Homo sapiens
catggggtgtgtgcaggtgtgtgtgtgcatgtgtgcccaggtgtttgagcatgtagatgggtgcacgtgtggggtatgtgcatggggtgtgtgcacgtgtgtgtgtgcgcccaggtgtatgagcgtgtggatgggtgcacgtatagaatgtgtaaatgaaatgtgtgcatatgtgtgtgtgtatgtgtgcccaggtgtatgtgtggatgggtgtgtgtgggatgtgtgcatgggtgtgtgtgtgtgtgcatgtgtgaccaggtatatgagtggatgggtgtgtgtggggtgtgtgcatggggtgtgtgcacgtgtgtgtgtgtgtgtgcccaggtgtatgagtggataggtacacgtgtgggatgtgtgcacatgtgtgaatgtgtgcccaggtgtatgaatgtgttgatgggtgtatgggaatgtgtacatgaaatgtgtgcgtatgtgtgtgcatgtgtgcccaggtgtatgactgtgtggataaatgtgtgggatgtgtccatggggtgtatgcgcgcgt

SEQ ID NO: 335686 - DNA, 352 bp, Homo sapiens
catactgggggagtggatttattttatctattttttaactacttctaaatacttcagggtgtattttctgaaaataagtacgttgaattgaattgagggtagtggagaaccattgaaagttttaagcagaatgatgtgatacagtggaggagtggaaggaaattaggctaacttgtaaagaaactggcagtttagatgtaattctgtaagtgaatggaagtcattaagtctgagctattgaatggatttgggtagtcttggtatggattgaggtaatatttgaagttatttgaatggaagaaattgaataggcagagaatttagagataaaagaggagagagggcttatgag

SEQ ID NO: 335687 - DNA, 258 bp, Homo sapiens
tcctcctctgctctccgctcagtgacccctgccctctgaaaagccctctagacccctgggttcccccaacctagtcctgcccactctgcggatgaatctgttcctctcactgagtcccgtgaagacagggctggtcaccgctgtggccccagcagtgctcagcaggaggctcaaacacccaaaatctgtgagccacagatatccaagaagacttaagactggacattgggactacgaccagtgtgcctgagatgaggt

SEQ ID NO: 335688 - DNA, 249 bp, Homo sapiens
agtccagaaatagatctaagtatattgggaacttaatatatgagataggtgggaagaggaagatgtatttaatgaataatgctggcatatttggctctcataaaaacaaaggcagagcccctacctcatacaagaagtaaattagagaattaagcatcacagataaaacagttaaaatattagaataaaattgtttaagcctggaggagaccttcctaagcaagaccaaacaatgcagtggcaatagta

SEQ ID NO: 335689 - DNA, 410 bp, Homo sapiens
gatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcaacgtggttcagggagtttcgtcctctttcttaaggatggcaagctcaaactgagtctcttccaggcgggacagtcaccaaggaatgtcacagcaggtgctggattaaacgatgggcagtggcactctgtgtccttctctgccaagtggagccatatgaatgtggtggtggacgatgacacagctgttcagcccctggtggctgtgctcattgattcaggtgacacctattattttggag

SEQ ID NO: 335690 - DNA, 204 bp, Homo sapiens
caagctggagccaaatggcttagatgtgtttacctgattcccaagggtgacacggacactgacccagaggtggcgggcacggcagggcagcactgcatccctgctgctgtgcagagtggccccatcttgtccattcagtcagcgaccactgctcagtgaatgggaacttggtatttctgtgtggtggctgtaagcctcagtcag

SEQ ID NO: 335691 - DNA, 94 bp, Homo sapiens
tgacaaaaagagcacaggagtgcttgggaatctctgctaagacaggtaagagaaatttcaataaacagtttggaggggtggatttatttgggga

SEQ ID NO: 335692 - DNA, 82 bp, Homo sapiens
catgtggtttttactcctagagtttgtttattcctcaccgcagcttggtgaggtaccactgttagcgttagtgtattaggac

SEQ ID NO: 335693 - DNA, 338 bp, Homo sapiens
ctcaggtgaagaaaccaagacacagtaaagaatgaatatgtaaaggatgtcagaactaggaagtgatggaatcaggaagagagcctggacagcctgccttgtgactcataggtcatctggccacaaaaacaatgaaatagaaaacctatccaataatcaatatggaatctcaagggatctcaaatagccaaaacaatcttgaaacagaagaacaaaactgaaggactcaacctttctaattttaaaacttactacaaacctaaagtaactaaaacagtgtggtattgacataaagacagaaatatagaccaatggaataaaataaaaagcctggaaat

SEQ ID NO: 335694 - DNA, 1361 bp, Homo sapiens
ctccagcatatgttcttgtttttatggaactgtactcaagactcgtctgggataaaatgtcatcagtagcctctggcaagtagagattccacatctgggtaacttcacctgtccttactttataatgcatgagcaccagtctgatactctggagttcttccattgccgtgccagcagagagatgactcatggcccaggtgaaattcaggtccaagctctggagagtgtgtggggactggtgaaaagacatggttttattgttatctgtttagttcctgctgcggaagatgagactctcgctctctttgtcatttccccacatgcacagaaacacacatatttctacttttctcatcctctcaacaggctatcataactttggttaaatcaatagtcagtgtttgtatattattattggataaatattacttacagtggaacccattttgtgtatgattagatattctttcttgtagaactttatgtttatccaggagttaatacttatctgattattttcagttgcttaatgtcctatacacctgttattaatttatgctgaactctccaacagaaactgaaatcttgtcttactatgtttaaacacattgggtattctacaagtttcttttcttatttatgtataattctcctagggctttccatcttcctgctctagtctaaactggttgttctctaggccagtggcaatgttatcatcctgatattctccttcaccatcagcctgggagttctgttggtttttctcctgtatggaatcctctatttcctgttatttttaaaaacttggtgtcaaccctaattttcatgggtatatttatgcaataacttttcagaaaaagatacaaaaaaagcaacattttttttcctgtgattttgcttacttgaaaatatctttattccatgggtcagccaactataggctgtaggctaaaatcctcccattttagtgaataaggttttattagaatacagccacatccatttgtttacttattatatattatgccacaatggaagatttgagaaattgcaataaagaacatttagatgataaaatctacaacatttattatctggacctttacgaagcaaatatttgctaacacttgctttattctatgttcacacaaaattgttaattttgctagatatagaattttaaagggctttttttttatcttctagcttccagagtgaatgtttaatagccttacaacattctgattcctaatcctttatataaaaactgttattttgtttgtttttggaagcttctgaaaccttctccttgttcttggtatgaacacttgtttttctaatgcaataaacacatgatg

SEQ ID NO: 335695 - DNA, 1318 bp, Homo sapiens
ctcaggtgaagaaaccaagacacagtaaagaatgaatatgtaaaggatgtcagaactaggaagtgatggaatcaggaagagagcctggacagcctgccttgtgactcataggtcatctggccacaaaaacaatgagagatgactcatggcccaggtgaaattcaggtccaagctctggagagtgtgtggggactggtgaaaagacatggttttattgttatctgtttagttcctgctgcggaagatgagactctcgctctctttgtcatttccccacatgcacagaaacacacatatttctacttttctcatcctctcaacaggctatcataactttggttaaatcaatagtcagtgtttgtatattattattggataaatattacttacagtggaacccattttgtgtatgattagatattctttcttgtagaactttatgtttatccaggagttaatacttatctgattattttcagttgcttaatgtcctatacacctgttattaatttatgctgaactctccaacagaaactgaaatcttgtcttactatgtttaaacacattgggtattctacaagtttcttttcttatttatgtataattctcctagggctttccatcttcctgctctagtctaaactggttgttctctaggccagtggcaatgttatcatcctgatattctccttcaccatcagcctgggagttctgttggtttttctcctgtatggaatcctctatttcctgttatttttaaaaacttggtgtcaaccctaattttcatgggtatatttatgcaataacttttcagaaaaagatacaaaaaaagcaacattttttttcctgtgattttgcttacttgaaaatatctttattccatgggtcagccaactataggctgtaggctaaaatcctcccattttagtgaataaggttttattagaatacagccacatccatttgtttacttattatatattatgccacaatggaagatttgagaaattgcaataaagaacatttagatgataaaatctacaacatttattatctggacctttacgaagcaaatatttgctaacacttgctttattctatgttcacacaaaattgttaattttgctagatatagaattttaaagggctttttttttatcttctagcttccagagtgaatgtttaatagccttacaacattctgattcctaatcctttatataaaaactgttattttgtttgtttttggaagcttctgaaaccttctccttgttcttggtatgaacacttgtttttctaatgcaataaacacatgatg

SEQ ID NO: 335696 - DNA, 105 bp, Homo sapiens
tcatgtataacttttacctgcttttgcattagaaggaaaactttgtcttactggttatatccaaacctcttgtgctaagtattttttatactttcactgaaaaaa

SEQ ID NO: 335697 - DNA, 621 bp, Homo sapiens
atgcaagaaacaacacagagaaattccatgcacactgcgcccagtttcctccaaaaaagacaagatagaggactgtatctgtatccagtgattcatccagattgtcacttccttttactgccaagtgacattctgtggtacgaaggggcctcactttaactattcactcactgaaggctatctagatcatttccagtttcccgctattataaataaagctgctatgaacatccacgtgtaggctattgtataaacatgtcttcatttctccaggataaatgctcaaggtacactggttgcatgtttagttttttgtttgttttgagacggagtctcgctctgtcgcccaggatggagtgcagtggcgctatatcggctcactgcaagctccgcctcccgggttcacgccattctcctgcttcagcctcccgagtagctgggactacaagcagccaccaccacgcccagctaattttttgtatttttagaagagacagggtttcaccatgttaaccaggatggtctcgatctcctgacctcgtgatccgcccgcctcggcctcccaaagtgctgggattacaggtgtgagccaccacgcctggccgcatgtttagtttttaa

SEQ ID NO: 335698 - DNA, 353 bp, Homo sapiens
ttttcttcttactttccccctttttaatgcctatagctttttgccaaaaaagttagctttttacaataataaagtactgctttgttaagttctactcatcacttacctacattgcccctaccaacgtaacaatttcatatcattttcctattagataggttcaaagatagactaaaatcctaaatgtattttgagatacatttaaaaatcaacttaaaaatgaattttgtgacatgtgagaaggagcatttgtgcatgtattttaaatattacattctggatattttgacatggtgttagcacaaagaattttcccttcaaaatcaacttagttaaaaagacaaactgttgtg

SEQ ID NO: 335699 - DNA, 203 bp, Homo sapiens
tcggcggactgattttgtctgtgcagcgggaaggaagaatccatcaggcaattacagtattcaggtaagaatgaattcactttgcagttttaaaaagccacagaaaagaacatggattacactgaatttcctatgatcaaaatttttatttgggaaaacttcaaacctcaagaaaattgaaagaatatgctcaacattatatc

SEQ ID NO: 335700 - DNA, 548 bp, Homo sapiens
gaggctgcggtgagctatgatcacactgctgtactcagctctctctaaaaagaaagaaaagaaaatctttataaatcctgtgaggcagcaccatttgccactgcagatatgccttctgcctgttgcttccatgccactctaccaagttaaagcaaacaaggccagtctcaaggcaaattttccaccctgtgtctcctcctttgctgtccaccaatctttagcagaaatatgaacttgttaatacatcattaaatattgtcttaaaaacgagtataactcacatctcaaattggagcaaagtcctttagactggtgatttccaagtgagtcaagtttgttattaaacacttttatgaagtaccatagctataaaatcacttcaggaattcaaggctatgattcttgagtggcaacaaagtttatatcctctttggtggaattgtttaatgatgctcttgagctgcccaggaagtagtaaggcctcctaagagttgtttcattattattttgggagttttgggttttttttttttctttttgagacagag

SEQ ID NO: 335701 - DNA, 659 bp, Homo sapiens
aatctgaagtggctgggggttggagaaagaaaaaaatgaaggggaaaaaaaggaaggagaaaagaaaaaggacagaaagttataaccagagtacagacacaggcatttagtatttctgaagaatagtaaggtccagtatctggcaatgggaataggttgctgaaacaaggtgtaggtgatgactgctggaactgatgtatgatgaagtgagaggtgacaatgttgccaagacattatatccagacactcagattgccaaagataatacagacatgaataggataagaaagagttggtcaaatttcctactggatgtgggtgaatgaccaagatatcaattaaggatagaagacagacaataaaatgaataaaatataagataattccatgatgaaaccataaagaaaaatgttttcctatgcagttaaaaatataaaagctcaaaagcactgcatccactcttgtagcacatggactgaataagaagccatatttctagagaaaagtcagaacatgcagaggaagcagtctgttaaaaagttgagggtaagctaaaactataaaagtcttagaagaaaacacagccataaatctatatgaaccttagattagacactgatttcttagatgtaatgccaaagcacaaacaacaaaaacaa

SEQ ID NO: 335702 - DNA, 154 bp, Homo sapiens
tgatgtggacctgacagatgcgattcccagccacacactgtattgttaaaaacggagcaggagtgtgacactgacagtaactgagagaaggaaggacatggaatgagaagagaggacagctgacatccagtggaatgtgaccgtgttaaatagc

SEQ ID NO: 335703 - DNA, 272 bp, Homo sapiens
tttgctaacagatcaatgtgataatttaacaatttattaaaacaacatttaaatttatgtcttgatcttaaaaaaaaaaaatcccaacaaaacggccgggtgtggtggcccacagctgtaatcccagcactttgggaggccgagatgggcagatcacctgaggtcaggagttcgagaccagcctggccaaaatggtaaaaccctgtctctactaaaaatacagaaattatccaggcatggtggtgtgtgcctgtgatcccagctactcggga

SEQ ID NO: 335704 - DNA, 230 bp, Homo sapiens
tgtaaaaaccttattcattctttaagactcaggtcaatgactgccttctcggtcaatattttcctgactctttttcaagaaaagttgagcaatcattccctctattttcctattattatagaactctgtgcttttaaaattcttgtattaatattaatatctattatgttgcctttttgtttgtttgcttctgtttccccccaatgactgatctccttaaaggcagagtt

SEQ ID NO: 335705 - DNA, 203 bp, Homo sapiens
ctatctatggagtcctaagtgttaggctgccgtgcagtcaccactttggagagaccacagagaaagacatggttgccagagtcccagctgtttctgtcttcccacatctgtgaataataaaggcttcaagatgatcccagacagcaaccatcttactgcaacatcatcagagatttagactcgattcacccagctgagctact

SEQ ID NO: 335706 - DNA, 558 bp, Homo sapiens
gagccggtcctactttccacaggggcatgacctgatgtacattacatgtgtccacccaggagggagagctccatttccctatctataaaatgcaggcataggactgattaatttgaaagcttctccagagaaatatcattgtataaactgtggtgttgcattatccaaatttttctctaaacaactggctgggattacaggcatgagccaccacacctgaccaagaaatcaaataagcttttgaaggctgtacatacaatctaatctgattttatccagccataaattaaaaattgttagttctgtgctccgtattctagttgctttcgcagacacgctttgctcacttaaagtctgtataataaccccattgtaaacacaaacaactgcaaatgtgtatgtgcgcagattaaccttttctagacactccttgtaattttcaaagccagtactggagttctagagtgcattagcacatgcatcaaatggtagattccccaggacctcaccgcagtgccaactgcagccccagcctacttcaccaaaaccacatcctgt

SEQ ID NO: 335707 - DNA, 201 bp, Homo sapiens
agacctgaaggaatagagggcagagaggagacctctgggaagtggcattctgtgctgaactttgtgtgagtccatgtgcctgaatccacacaaagggagaaaaagatgctgaggaaatcaagatgaacagatacagatcatttctttgagtgtccggcaacatgtttttgatcatctgtgctaaataggagataaggttgc

SEQ ID NO: 335708 - DNA, 422 bp, Homo sapiens
ggtgtatctatctgttgtgagcagggtagaagctcttctaaacaatctctgattaagaaactcattgtattaatagacgctcttcatcccctctatgagcacactgtcagattcttgaaactcactgaatggtcgtatctgtaaacttctctcttacataccatttcgataaaccatctgatttccacttggataagtgaacatctatggtaatagaaatatattcatgatacttaattttaaagtaaactattaataagaatttaagagaattttcaaggtccagagtgagactatgcctcagtaggagtctggtataaagaaacagaaagccaacatgaattgcttgccatctcttatctctaaatctttatgtgccctgtttcattcttgtcagtcttacttttctaatactcatctac

SEQ ID NO: 335709 - DNA, 430 bp, Homo sapiens
tatctcgtgtcctgcgatctgggtcagcagctcggtcgtgtcatctgggatgcaggctcctttcctctttctcctcctccatttcatagctccaggttcaccactgcacagtaatggccagagcaagaaagggaccattgtgccctgtgcccccttctcaggcaccaggtagactttccctctgtctcgttgaccaggactaagtcaagtatgtatccctagtagggaacgtgatgagcctaatggcatgggcagtgacatccccttactggtgagatcccaggtggggagctcactccacagaaacagtttgtaatgagagaactctctctgcaacaaggtattcgctgcagcatcatttgtaacaggaaaaagctagaacactctacataccctgactagggcctaattgagtaaatgaggttttatc

SEQ ID NO: 335710 - DNA, 310 bp, Homo sapiens
ccagttcccttttgctatttcattcttttgactgcttttactgagtactcactaaatgcagctaaacgaacaaagtatgtgcctggaactaaattcactaacttaaagaaaatcaagcagccatgcacaaacagaagaacatttaaaaaaaattaaaatacttagaatcctatccagtgtaatgatgcgaatttatttaacaattcttggtccagtttttgtccatttggtattccatatctccctgcctccctcagtgtaactcttcacttgaaggaaagaatggaacaacaaaaaaaaaaaagacaat

SEQ ID NO: 335711 - DNA, 340 bp, Homo sapiens
  misc_feature (40)..(42): n is a, c, g, or t
cgcagcacaaatcacggacatcactaaatgagaaacaaannntttagaaaaactgacccatctgaatttttagtgcctttatggaatttctgtactttgaccaaccagaagaaggactatttttgttaaagaatgttcatccgagccattccaaacatgccatagaagcaactgactattgaaggagacacccttgctttgacattttataacaatgatctatgtaatacttaagactctttaaatttgagataatagaaaatgtaactcaaactagtttaaacaataaagtgaatttattggctcatctaaaaaaaaaaaatttttctcgttggcctaa

SEQ ID NO: 335712 - DNA, 311 bp, Homo sapiens
  misc_feature (40)..(42): n is a, c, g, or t
cgcagcacaaatcacggacatcactaaatgagaaacaaannntttagaaaaactgacccatctgaatttttagtgcctttatggaatttctgtactttgaccaaccagaagaaggactatttttgttaaagaatgttcatccgagccattccaaacatgccatagaagcaactgactattgaaggagacacccttgctttgacattttataacaatgatctatgtaatacttaagactctttaaatttgagataatagaaaatgtaactcaaactagtttaaacaataaagtgaatttattggctcatcta

SEQ ID NO: 335713 - DNA, 365 bp, Homo sapiens
  misc_feature (40)..(42): n is a, c, g, or t
cgcagcacaaatcacggacatcactaaatgagaaacaaannntttagaaaaactgacccatctgaatttttagtgcctttatggaatttctgtactttgaccaaccagaagaaggactatttttgttaaagaatgttcatccgagccattccaaacatgccatagaagcaactgactattgaaggagacacccttgctttgacattttataacaatgatctatgtaatacttaagactctttaaatttgagataatagaaaatgtaactcaaactagtttaaacaataaagtgaatttattggctcatctaaaaaaaaaaacaaaccagacaccctcaccccttcattggcctttgttggcctca

SEQ ID NO: 335714 - DNA, 259 bp, Homo sapiens
tctctgtttctattacagggacccatctgaatttttagtgcctttatggaatttctgtactttgaccaaccagaagaaggactatttttgttaaagaatgttcatccgagccattccaaacatgccatagaagcaactgactattgaaggagacacccttgctttgacattttataacaatgatctatgtaatacttaagactctttaaatttgagataatagaaaatgtaactcaaactagtttaaacaataaagtga

SEQ ID NO: 335715 - DNA, 257 bp, Homo sapiens
gaaatttctctcccatattagtagtatgagaacctgatcaagctcctggaggtaaaactcacagaagcatgggagccctcctctgtgactgggttttcccggagtttttaactctcagacttgcccacactaggtctctaggaatttgtcaattacatttgagctttccctatgcaggcacttgttcctccagtggattctgctttcattatgttgtgattctctgaatctgcctgtttttctctatgattctgggg

SEQ ID NO: 335716 - DNA, 175 bp, Homo sapiens
attctcctgcctcagcctcccaagtagctggaacaacaggcgtgcaccaccatggctggctaagacctttccccctattttcttaatgtcttttagtgagtcccatcatctgtaggtcaagttccagttctagagcttggtacccaagacttcccataatctgacccagcccttc

SEQ ID NO: 335717 - DNA, 765 bp, Homo sapiens
cgttgtattaagaacctcacttagattatctgattcaatcttcataataaccctgcaacccccacctttttttgagacagggtcttgctctgttgtccaggctacagtgcactggtacaatcatagttcactgcagtgtcaacctcctgagctcaagcaatcctcccacctcagccttgcaagcagcttggactacaggcgtgccaccacaccttgccatttttttttattttaagtagaaacaaggtcttattaatactatgttgcccaggctggtcttgaactccagcgatcctcctgccccagcctcccaaagtgcttgggattacggaagtaagccactgtgcctggccagtgcaacccccattttatactaaaacaggaaggcccagaaaggtttggagtaacttgtccagggtcacacagatgatatttgaactcaggtctccctggctcccaagagagtctgctttccactaggactcccaggagaaaaaaaaaaaaaaaacagtagacttggagacagaaaatctgatttgagtcttagttgagctaggctaactgtgtaactgtgggcaagttccttagcccctgtgagcctcagtttcttatctgtaaaatgtcataaaagaaatccatctcatggagtagttgtgatgatcaaggactctgaaaacattagaatggtttaatgtgaaggattagcagcagcacatggcaacattgtgcatcttatattaactatccaaatatatcaagcgtcat

SEQ ID NO: 335718 - DNA, 633 bp, Homo sapiens
cgttgtattaagaacctcacttagattatctgattcaatcttcataataaccctgcaacccccacctttttttgagacagggtcttgctctgttgtccaggctacagtgcactggtacaatcatagttcactgcagtgtcaacctcctgagctcaagcaatcctcccacctcagcctcccaaagtgcttgggattacggaagtaagccactgtgcctggccagtgcaacccccattttatactaaaacaggaaggcccagaaaggtttggagtaacttgtccagggtcacacagatgatatttgaactcaggtctccctggctcccaagagagtctgctttccactaggactcccaggagaaaaaaaaaaaaaaaacagtagacttggagacagaaaatctgatttgagtcttagttgagctaggctaactgtgtaactgtgggcaagttccttagcccctgtgagcctcagtttcttatctgtaaaatgtcataaaagaaatccatctcatggagtagttgtgatgatcaaggactctgaaaacattagaatggtttaatgtgaaggattagcagcagcacatggcaacattgtgcatcttatattaactatccaaatatatcaagcgtcat

SEQ ID NO: 335719 - DNA, 507 bp, Homo sapiens
gaatgtcttccaggcacttcagactctcttctctagactttgctggactttcactcttccccctaaaactggctcctcttccactgtgcctggccagtgcaacccccattttatactaaaacaggaaggcccagaaaggtttggagtaacttgtccagggtcacacagatgatatttgaactcaggtctccctggctcccaagagagtctgctttccactaggactcccaggagaaaaaaaaaaaaaaaacagtagacttggagacagaaaatctgatttgagtcttagttgagctaggctaactgtgtaactgtgggcaagttccttagcccctgtgagcctcagtttcttatctgtaaaatgtcataaaagaaatccatctcatggagtagttgtgatgatcaaggactctgaaaacattagaatggtttaatgtgaaggattagcagcagcacatggcaacattgtgcatcttatattaactatccaaatatatcaagcgtcat

SEQ ID NO: 335720 - DNA, 263 bp, Homo sapiens
acctctgctgattttattctatatcttgtcactgtaataaatcataaccctgaatataatggctttgctaagttctctgagtccttctagcaaatcatggaacatcaggatgatcttggaggatcccccgatcatgcttatttcccccagaacaatgtgattacaacagtgcagcgcaatgtaggtctacaagcacgctacttccccgtatcatagaagacgcttatcacctcttcatgtatcacgaccctgggctaccgaga

SEQ ID NO: 335721 - DNA, 295 bp, Homo sapiens
acctctgctgattttattctatatcttgtcactgtaataaatcataaccctgaatataatggctttgctaagttctctgagtccttctagcaaatcatggaacatcaggatgatcttggaggatcccccgatcatgcttatttcccccagaacaatgtgattacaacagtgcagagttttccttaacttttatttttttccttgcaaaataggtttaagatatttttatttgttgcaaaagacagacctgtgacttctattcctgatgtctgtctctcattgctttttttttttt

SEQ ID NO: 335722 - DNA, 501 bp, Homo sapiens
atggaggtcactgtagccagagtccagggtgtggggattggaaggagcgagactggcgctggaagcaggggctagaatcacatgggaccttgtaatcagggtggggagtatcaataactgtgacagttgacaatagctgttggcaagatttgagtttagtagattgaaccagggtaactgagacagaggtggtgtgaagcggccacattctggctctgttttgaggtagaggtgatgttatgtggacatgagaggaggagaggagtcagggatgacactggggcatttgtcctgagcagctgtgtcctggaggagcccaaccgggggatgcaggagcaagaggtgggttttggccagtgtgtcggagaggcccgtgagcctcccagggggagatgctgagccagcagctcgggccatgccggatctggagctcagggagaggctgagtgaggaggcatcagcacgtggatggaattttaggtcacaggagggagagggtca

SEQ ID NO: 335723 - DNA, 1078 bp, Homo sapiens
gtggcgttttcttcggtttcgacttccggtaggagagtcccaaacggccagcggctgggaatttgcggtgggaaggatacgagcaagataaagcagcgagggatttaagtctggcaacagttggactgctggattttcagagaagtgttccccaaagcaaattatagtgctaatttccaatgttccataagcgtggcaagaaaaatgggaagttctcggtaaggtatatagtattatttctagaaataaagatgaaccaatccaagattgattttttgtttgtttaatcctggcagtattcttaactaaattgtattcattcttccctttactttccagactttttaattttatttatttttttattttttgggacggagtcttgcccaggctggagtgcagtgccacaatcttggctcactgcaacctctgcctccctggttcaggcgtttctcctgcctcaccctcccgagtagctgggactacaggcacgtgccatcacgccaggctagtttttgcatttttagtacagatggggttttacatgttgatcaggctggtcttggactcctgacttggtgatccacccgcctcagcctcccaaagtgttgggattacaggcatgagccactgcgccaggccactttccagatactatagtccctaatttattgtgtctcaaatgccaaataaatttgagcttagactggagctgctgtactgatacaggattggatttatgggtgaatgggtgactataggtgtcatgttattttcatagaaccattcaggtttgaaattaagaaggaaagaagttcccttgaatggagatagccagaggcagaattaagacctttcttccaagatcagtctgaaataacattttggcaagtaaaagaggcatgtctgtcatagaagaaataaaaaggcaacctggaagaacagaaaaagggaggactagatagaaattagttaactgtctagctgggcatggtggcaggcacctgtaataccagctactcaggaggctgaggcaggagaatcgcttgaacccaggaagcggaggttgcagtgagcc

SEQ ID NO: 335724 - DNA, 721 bp, Homo sapiens
gtggcgttttcttcggtttcgacttccggtaggagagtcccaaacggccagcggctgggaatttgcggtatcgcgggggggtgggaaatttcccttggtgcgtgctccttctgatgtcagccttcaaaacgtttgtgggactcccctttgatttgagtctctgctgctagcagctgcttccctgacctctaaaaccaggaaagaccataggttctctaagtgagcagccgccgtttgctgcccttagaaaactcacagaagtgaagagtgtttctttcctgacttattcctgttcccctaggcaggcgtgctaggggttaggagttctgccgtgattcttcttcattcatttattaatctattcattcacgtattcattcattggcttatgcatttatgtactcattgattgattgatcgattgcagacgaggtcgggctgtgttgcccagggggactcaatttcctgggctcaagcgatcttcctgcctcgacttcccaaagtggtgggattgcaggctcagccaccgcgcccggcccctgtcgtgattcttagttctgaaaagaattgattgggagacgagccatggaaggcctggagccacagagttcagttatgtgattaataataacacataataataacacatagcacccctctccattttgccaagcattaggtatgttcgtggatcccagatcgaagtccacgcataagccaa

SEQ ID NO: 335725 - DNA, 314 bp, Homo sapiens
tccgcccacctcggcctcccaaagtgctgggattataggcgtgagccactgtgcccagccccctctggctacttttaagattttcttgttatcactggtttgagcaatttgattgtcatggaccttggtgtagtttttctctgtgtttcttttgttgaggattcgttaagcttttttgatttgtggctttatagttttcatcaaattttgaaaaactttgtccattatttcttcaactatccaataaacccccctccccgctgacctttagggactctatttactcacttattaggctctttgaagttccacag

SEQ ID NO: 335726 - DNA, 626 bp, Homo sapiens
acaggagaatcgcttgaacccgggaggcagaggttgcagtgagccaaggttgcaccactgcactccagcctgggtgacagagagagactctttctcaaaaagaaaaagaaagacggggatgctgatgcccccagcacaggttgagccgaacagatgccccaggtgtttgaaaggacaggcgaaagtgcagcgagcgtgaacctggcccctcctcccctcacctgtcctacctcatttagcagcatcttcttatagcttctgtgggaaaagtcatggtaataaaaacataatgctttaatcaataacacccatgtctctgttttagctttttattctgggaatgctcagatatacacaaaagcagagtgtagagcatcccaagcccctgggtattcgtctcccagcaccacctggacaacatggcaaaaccctgtctctactaaaaatacaaaaattagttgggtgtggtggtacacatctgtaatcccagctactaggaggcggaggcaggagaatagcttgaacctgggaggcagaggttgcagggagctgagattgtgccactgcactccaatcttggtgacagagcgagactccgcgtcaaaaaaaaaaatcattctgtgtcc

SEQ ID NO: 335727 - DNA, 234 bp, Homo sapiens
taacgactaggtcctactggcttatgtattgaaaagtagatcaatgaactcattctggagctaaatgttgtctattactgtggattatccatgacataacccactcattatattccagtattggttaaaaggtaggagagaagtgatagtaaatttcatgggttcggcatatcttctgaccgacagaagacatggaaatgttttaaatgtttcttttccttttttttttttttt

SEQ ID NO: 335728 - DNA, 400 bp, Homo sapiens
gtggaaggatcatttgagcttgggaggtcgagaatgcagcgtgcaataattgtgacactgcacgccagcctgggagaaagaacaagactttatctcaaaaaaaaaaagaaaaagaaaaagtaacccacaaatggaaaatatttgcaaatcatatatctgataaaggactagtatccagaatacataaagaactcatagcactcaaaaataaaagagcaaataacccaatcttaaaataggcaaaagatttgaatagatgtttttccaaagaagatgtacaaatggccactaagcatatgaaaagatgctcaacattactagtcattagggcaacactaatcaaaaccaaaatgagataccacttcacacatgctagaatgctcagaattaaaaacatgaa

SEQ ID NO: 335729 - DNA, 184 bp, Homo sapiens
aaataaaaacacacctcaccaagctcagccaccaacttaaaaaggactggacaatacttttaccactttcccttctcagaattcaggcctgtcctcggaatgctacagggtacagcccatttgagctcctgtatggatactcctttttgttaggccccagtctcattccggacactagaccaac

SEQ ID NO: 335730 - DNA, 310 bp, Homo sapiens
gccactgcactccagcctgggcaacagagcgagactgtctcaaagaaaaaacaaacagccagtttttttttttttttttttttaaatcctggattttaagaactaagccagccaggttttcatcaggctgacttttcattaaaatactgttttttttttctttttgctaactataaaatcatattgtcatgtcgaatatactttttcaaattacgctcctgtgtgatattttcctgggccacatcacagattactgaaaagatacttcatgctacggaccacagaaaagtttgtcaggacataggtgtga

SEQ ID NO: 335731 - DNA, 572 bp, Homo sapiens
gctggtctcgaactcctgagctcaaggcatccacacaccttggcctcccaaagtgctggaattataggcacgagccaccgtgcccggccaagactaaatttttaaattcatgccaggatccttttcattaactactcacacaattgttctgtaatctacctaagcagcataaatatgtattgaaattctcctgaccatgacatttaacgtgcattcacattttccaatactggttttgcttgttcctctaacgacacattctgaaagtgggagttctttctttggtttatctaatacagatggctccacgggagaccagaggaaccacatggggccttgagccaacggacatagtatgtcactgcagctccttacattttatcattgtaaagatacccatatagtcttctgttgagaatgaaatattattattattattattattattattattatttgagacggagtctagctctatagcccgggctggggtgcagtttcgtgatctcggctcactgcaacctctgcctcctgggttcaagtgattctcccgcctcagccttctgagtagg

SEQ ID NO: 335732 - DNA, 241 bp, Homo sapiens
tcttggtcctcacctggagattcaatctgccttgttcagttgaagattcattagacttaggtcaccactgttgtggcccaccagtttgactagaaaaccgagggctttgacttctctgccctgctgtcttacacaagcaccaactgtgccactgtcaaaaggctgttcgagccaatgtgcacacactcagacactccacatgctaacataacagtaactgctgccgctgaatgccaactat

SEQ ID NO: 335733 - DNA, 259 bp, Homo sapiens
tgtcaaaatgtctattgtttcctgtccaggacctatttatatagacatatttatgctcatccattagcaattcatagttaaaccttggcacatcaagctacaaaaacaatcttataaatagatgatctgaagaacaaatcaatatgtattataggctagaatgtggttctgcctttgatttattggttctatttgtatcgtttccttcagtgtaatgtaatatgggggtagaagaccacagttagagagatcttatttc

SEQ ID NO: 335734 - DNA, 1220 bp, Homo sapiens
  misc_feature (1220)..(1220): n is a, c, g, or t
ctttgaggcccaagggggagcgagccggtgctgctgcaggctgaggctgcggcagaggcggcgaggcgcgggcggtgaggacggacagtcaccgacttagtccagttccctgtgatctcaaaacaattgttgcagcaggctcctggcagtctcaagcagttcatcttcttggtgtactggtttcctattgtgattttatcatggaaaatcaattggctaaatcaactgaagaacgaacatttcagtaccaggattctcttccatcactgcctgttccttcacttgaagaatcattaaaaaaataccttgaatcagtgaaaccatttgcaaatcaagaagaatataagaaaactgaagaaatagttcaaaaatttcaaagtgggattggagaaaaattgcaccagaaattgcttgaaagagcaaaaggaaaaagaaattgggtatttgttgttataattgaataatgatgatgtttaaagaatgataaataaaaagtgcatagtttttatttttaaattattgctgtaaaaatttttacagttattattgttattttcataatccaaaagaaggaatgaatcacttaactttgggagttttcagtgggtggattcgggaacttgttaaaatgcagatttgctgggataagtgattctgattcacatggctggaatgaggcccagagattcttattttaacaatcacttcatgtggtttggctgcaggtaatctgtagaccatgctgaaggaaaacattttgtccaggtgactagcttgaaaaatcagaaacactaaaatagacatgtcacataggtggcatagaaatattttcgtagtacaatggagaaagggaatcattaaaaatcagagtggagaatggttatgtatattgtatatttcagttagataaattgaggaagctagtataataattattgaaggtctcaataattttccacaaaattctttaacttcttcagctcaaccatttctgtacttctctactatgaatcagaggatgaggttgtataattcaaaagcattgccttagtctagaaataattattgtacctatcatttagttttagaaataaaaagcaagctgattttttttgatgaaccatttatatctgtgatggaataataaaatttcacacttccggattcctttgttctcaattttgagccttgagttgttttaattaaagaggggtaaaggn

SEQ ID NO: 335735 - DNA, 1163 bp, Homo sapiens
ctttgaggcccaagggggagcgagccggtgctgctgcaggctgaggctgcggcagaggcggcgaggcgcgggcggtgaggacggacagtcaccgacttagtccagttccctgtgatctcaaaacaattgttgcagcaggctcctggcagtctcaagcagttcatcttcttggtgtactggtttcctattgtgattttatcatggaaaatcaattggctaaatcaactgaagaacgaacatttcagtaccaggattctcttccatcactgcctgttccttcacttgaagaatcattaaaaaaataccttgaatcagtgaaaccatttgcaaatcaagaagaatataagaaaactgaagaaatagttcaaaaatttcaaagtgggattggagaaaaattgcaccagaaattgcttgaaagagcaaaaggaaaaagaaattgggtatttgttgttataattgaataatgatgatgtttaaagaatgataaataaaaagtgcatagtttttatttttaaattattgctgtaaaaatttttacagttattattgttattttcataatccaaaagaaggaatgaatcacttaactttgggagttttcagtgggtggattcgggaacttgttaaaatgcagatttgctgggataagtgattctgattcacatggctggaatgaggcccagagattcttattttaacaatcacttcatgtggtttggctgcaggtaatctgtagaccatgctgaaggaaaacattttgtccaggtgactagcttgaaaaatcagaaacactaaaatagacatgtcacataggtggcatagaaatattttcgtagtacaatggagaaagggaatcattaaaaatcagagtggagaatggttatgtatattgtatatttcagttagataaattgaggaagctagtataataattattgaaggtctcaataattttccacaaaattctttaacttcttcagctcaaccatttctgtacttctctactatgaatcagaggatgaggttgtataattcaaaagcattgccttagtctagaaataattattgtacctatcatttagttttagaaataaaaagcaagctgattttttttgatgaaccatttatatctgtgatggaataataaaatttcacacttccgg

SEQ ID NO: 335736 - DNA, 3270 bp, Homo sapiens
ctttgaggcccaagggggagcgagccggtgctgctgcaggctgaggctgcggcagaggcggcgaggcgcgggcggtgaggacggacagtcaccgacttagtccagttccctgtgatctcaaaacaattgttgcagcaggctcctggcagtctcaagcagttcatcttcttggtgtactggtttcctattgtgattttatcatggaaaatcaattggctaaatcaactgaagaacgaacatttcagtaccaggattctcttccatcactgcctgttccttcacttgaagaatcattaaaaaaataccttgaatcagtcaccagaacatgctaccagataaggggtcttgatccagatgctaagagagggttcttggatctcacgcgggaaggaattcaagtgaaaccatttgcaaatcaagaagaatataagaaaactgaagaaatagttcaaaaatttcaaagtgggattggagaaaaattgcaccagaaattgcttgaaagagcaaaaggaaaaagaaattggctggaagagtggtggctgaatgttgcctatctggatgttcgtataccatcacaattgaatgtcaactttgcgggtcctgcagctcattttgaacactactggcctccaaaggaagggactcaattagaaagaggaagtataactctttggcataacttgaactactggcagctattaagaaaagaaaaagtgcctgttcataaagttggaaatactcctctagatatgaatcaattccgaatgctattttctacctgcaaggttccaggaattactagagactccattatgaattattttaggactgagagtgaagggcgttccccaaaccacattgtagtgctgtgtcgaggccgagcttttgtctttgatgtaatacatgaaggatgtttggtcaccccgccagagcttctcagacaactgacatatatccacaagaagtgccatagtgaacctgatggacctgggattgcagcattaactagtgaggagcgaactcgatgggctaaggcacgagaatatctgattggtcttgatccagagaacttggctttgttagaaaaaattcagagtagtttactggtatattccatggaggatagcagtccacatgtaacaccagaggattattctgagattattgcagccatccttattggagatccaacagtacgctggggtgacaaatcctataacttgatttccttttctaatggagtatttggctgtaattgtgatcatgctccttttgatgcaatgattatggtgaacatcagttattatgtggatgagaaaatttttcagaatgaaggaagatggaagggttcagagaaggtacgagatataccacttccagaagagctcattttcattgtggatgagaaagttttaaatgacatcaaccaagctaaagcccagtatctcagggaggcatctgatctacagattgcggcttatgcctttacatcttttggcaaaaagctaaccaagaacaagatgcttcacccggatacgtttattcagcttgcacttcagctggcctattacagacttcatggacaccctggttgttgctatgaaacagctatgacaagacatttttatcatggccgtacagagactatgcgatcatgcacagttgaagcagtgaggtggtgccagtccatgcaggatccttctgtcaatcttcgtgagcggcagcaaaagatgttacaagcttttgcaaagcataataaaatgatgaaagattgttcagctggaaaaggatttgatcgtcaccttttaggtctcttactcatagcaaaagaggaaggtcttcctgttccagaactctttacggacccacttttttccaaaagcggaggaggtggaaattttgttctctcaacaagtctggttggctatttacgagtccagggagtggtagttcccatggtacacaatggttatggatttttctaccatatcagagatgacaggtttgttgtggcctgttcagcctggaaatcctgtcccgagactgatgcggaaaagctagttcagctgactttttgtgcttttcatgatatgatacagctgatgaactctactcatctttagagatgaatcatctattaagcacttaccaaaacatatcattaaactgagtgctgggagtgagttggtaatatgagatgggaaggaatgttgacttgctaacattcctttaacaagttaagaaaacttgttaaatgtagaaattagtagaatcatgctctctaaatttattctgccatagaaggtagaaatatttttaagctcctctgatgcagcagcaatgcaaattatgacatagtgaatatagaactatgcagtatttaagcctcaacaatccaaatctacaaactttaacaatgcaagtcttactctaatttttaagtatttttgttggtacttacatgggttataaatcctctctctggacatcaatgtagagtccatctttcaagcactttaatttttttagctgccaaagggtatgaattacattattgtatgctaatttccctgaaatcaatgccttctatgttcaccacagggatacaagcctgttatgtttgatgggaaagaccactacaatctaatggtgatctaaaataacttttttgggctgggtgcagtggctcatgcctataatcttagcactttgggaggccaaggtaggaggattgcttgaagctaggagtttgagaccagcctgggcaacagggtaaggtcctgtctctacaagatcaaaaacttagccgggtatggtggtgcatgtgtgcctgtagtccaagctacttgaaggctgagacaggaggatcggttgagcccaggaggttgtggctgcagtgagctgtgatgtgcccttatgctatagcctgggcaagagcgtgagaccctgtctcaaagaagaaaaaaagagaaaaataactcttttgaacaaacagacaaattagctagtagtatggagatgtataccctctattacacacataaaaccgtaacaaaattcattgtggtgtattataattagttttgtgaatagaaaaataaagcacttatgtttaaatttgttacagtgacttttaaaggattaatgttgaatcacattgtcagaattttttcctcctcgctgttcaattttgtagtttttactctcaaaaaatgaaattctcaaaattatatagctttttgttttgtttgaataaatgattcattcctg

SEQ ID NO: 335737 - DNA, 3001 bp, Homo sapiens
ctttgaggcccaagggggagcgagccggtgctgctgcaggctgaggctgcggcagaggcggcgaggcgcgggcggtgaggacggacagtcaccgacttagtccagttccctgtgatctcaaaacaattgttgcagcaggctcctggcagtctcaagcagttcatcttcttggtgtactggtttcctattgtgattttatcatggaaaatcaattggctaaatcaactgaagaacgaacatttcagtaccaggattctcttccatcactgcctgttccttcacttgaagaatcattaaaaaaataccttgaatcagtgaaaccatttgcaaatcaagaagaatataagaaaactgaagaaatagttcaaaaatttcaaagtgggattggagaaaaattgcaccagaaattgcttgaaagagcaaaaggaaaaagaaattggctggaagagtggtggctgaatgttgcctatctggatgttcgtataccatcacaattgaatgtcaactttgcgggtcctgcagctcattttgaacactactggcctccaaaggaagggactcaattagaaagaggaagtataactctttggcataacttgaactactggcagctattaagaaaagaaaaagtgcctgttcataaagttggaaatactcctctagatatgaatcaattccgaatgctattttctacctgcaaggttccaggaattactagagactccattatgaattattttaggactgagagtgaagggcgttccccaaaccacattgtagtgctgtgtcgaggccgagcttttgtctttgatgtaatacatgaaggatgtttggtcaccccgccagagcttctcagacaactgacatatatccacaagaagtgccatagtgaacctgatggacctgggattgcagcattaactagtgaggagcgaactcgatgggctaaggcacgagaatatctgattggtcttgatccagagaacttggctttgttagaaaaaattcagagtagtttactggtatattccatggaggatagcagtccacatgtaacaccagaggattattctgagattattgcagccatccttattggagatccaacagtacgctggggtgacaaatcctataacttgatttccttttctaatggagtatttggctgtaattgtgatcatgctccttttgatgcaatgattatggtgaacatcagttattatgtggatgagaaaatttttcagaatgaaggaagatggaagggttcagagaaggtacgagatataccacttccagaagagctcattttcattgtggatgagaaagttttaaatgacatcaaccaagctaaagcccagtatctcagggaggcatctgatctacagattgcggcttatgcctttacatcttttggcaaaaagctaaccaagaacaagatgcttcacccggatacgtttattcagcttgcacttcagctggcctattacagacttcatggacaccctggttgttgctatgaaacagctatgacaagacatttttatcatggccgtacagagactatgcgatcatgcacagttgaagcagtgaggtggtgccagtccatgcaggatccttctgtcaatcttcgtgagcggcagcaaaagatgttacaagcttttgcaaagcataataaaatgatgaaagattgttcagctggaaaaggatttgatcgtcaccttttaggtctcttactcatagcaaaagaggaaggtcttcctgttccagaactctttacggacccacttttttccaaaagcggaggaggtggaaattttgttctctcaacaagtctggttggctatttacgagtccagggagtggtagttcccatggtacacaatggttatggatttttctaccatatcagagatgacaggtttgttgtggcctgttcagcctggaaatcctgtcccgagactgatgcggaaaagctagttcagctgactttttgtgcttttcatgatatgatacagctgatgaactctactcatctttagagatgaatcatctattaagcacttaccaaaacatatcattaaactgagtgctgggagtgagttggtaatatgagatgggaaggaatgttgacttgctaacattcctttaacaagttaagaaaacttgttaaatgtagaaattagtagaatcatgctctctaaatttattctgccatagaaggtagaaatatttttaagctcctctgatgcagcagcaatgcaaattatgacatagtgaatatagaactatgcagtatttaagcctcaacaatccaaatctacaaactttaacaatgcaagtcttactctaatttttaagtatttttgttggtacttacatgggttataaatcctctctctggacatcaatgtagagtccatctttcaagcactttaatttttttagctgccaaagggtatgaattacattattgtatgctaatttccctgaaatcaatgccttctatgttcaccacagggatacaagcctgttatgtttgatgggaaagaccactacaatctaatggtgatctaaaataacttttttgggctgggtgcagtggctcatgcctataatcttagcactttgggaggccaaggtaggaggattgcttgaagctaggagtttgagaccagcctgggcaacagggtaaggtcctgtctctacaagatcaaaaacttagccgggtatggtggtgcatgtgtgcctgtagtccaagctacttgaaggctgagacaggaggatcggttgagcccaggaggttgtggctgcagtgagctgtgatgtgcccttatgctatagcctgggcaagagcgtgagaccctgtctcaaagaagaaaaaaagagaaaaataacttgccgcggtttacaactctgacttggaaacctggcgttccccaattaatcgccttgaagaaattcccttttgcaggtgcgtaatacaagaaggcccaccgatcgc

SEQ ID NO: 335738 - DNA, 1067 bp, Homo sapiens
ctttgaggcccaagggggagcgagccggtgctgctgcaggctgaggctgcggcagaggcggcgaggcgcgggcggtgaggacggacagtcaccgacttagtccagttccctgtgatctcaaaacaattgttgcagcaggctcctggcagtctcaagcagttcatcttcttggtgtactggtttcctattgtgattttatcatggaaaatcaattggctaaatcaactgaagaacgaacatttcagtaccaggattctcttccatcactgcctgttccttcacttgaagaatcattaaaaaaataccttgaatcagtgaaaccatttgcaaatcaagaagaatataagaaaactgaagaaatagttcaaaaatttcaaagtgggattggagaaaaattgcaccagaaattgcttgaaagagcaaaaggaaaaagaaattggctggaagagtggtggctgaatgttgcctatctggatgttcgtataccatcacaattgaatgtcaactttgcgggtcctgcagctcattttgaacactactggcctccaaaggaagggactcaattagaaagaggaagtataactctttggcataacttgaactactggcagctattaagaaaagaaaaagtgcctgttcataaagttggaaatactcctctagatatgaatcaattccgaatgctattttctacctgcaaggttccaggaattactagagactccattatgaattattttaggactgagagtgaagggcgttccccaaaccacattgtagtgctgtgtcgaggccgagcttttgtctttgatgtaatacatgaaggatgtttggtcaccccgccagagcttctcaggttttcagactactttcttgagtttcattaggtcttatggtgttgcttgaattaaaatatacatgtttagaattgcctttcaaggtgatagtaagctgaaaaataagaattttatgcatgcttttttaaaaaaaaactatttgtattttttatttaaattatttttaaattttactagacatatataaatatgttcccttggaaaaaaaaa

SEQ ID NO: 335739 - DNA, 796 bp, Homo sapiens
cactatatatacatgtgtatatgcatgcaaacacatatataaaataggagtttcacagagcactaattacttttattgtctgtgaggtacactgatatttccagtctattttattctccttttttgtaaggaatattgattatgatgcactgagttaatttcatgatccattaataggccaaagtatacagtttgaaaaacaggtttagtaggaaacgaattcttaaaatatttcctcctaactagactttaatgactaaacttttatcaagatcttttatcctattcaagttacaaaacccttatcctctcaattctatgttctgtaaacattcatgaatattgtaccagcattttcttttctggtaggattttcttaacttgagattttgagaagcccctaaagtcagggccagaattactctctcttgactttgcatatcacatatcagtgttgctgatcataactatattatgattttattaaatttggttgacgtgaagaggaatggtgagatgatatatgtgtttaagatgtaaattcttacaaaccaatattaaacccttttaatttggaaaaattaaatttattttagattattgcagccatccttattggagatccaacagtacgctggggtgacaaatcctataacttgatttccttttctaatggagtatttggctgtaattgtgatgtaagtaaactactgaaatttttctcttttgatcttttaggttaaattaatgacaataaaccataaatacttgtgctggggaacagtgtaagtgaata

SEQ ID NO: 335740 - DNA, 3186 bp, Homo sapiens
ctttgaggcccaagggggagcgagccggtgctgctgcaggctgaggctgcggcagaggcggcgaggcgcgggcggtgaggacggacagtcaccgacttagtccagttccctgtgatctcaaaacaattgttgcagcaggctcctggcagtctcaagcagttcatcttcttggtgtactggtttcctattgtgattttatcatggaaaatcaattggctaaatcaactgaagaacgaacatttcagtaccaggattctcttccatcactgcctgttccttcacttgaagaatcattaaaaaaataccttgaatcagtgaaaccatttgcaaatcaagaagaatataagaaaactgaagaaatagttcaaaaatttcaaagtgggattggagaaaaattgcaccagaaattgcttgaaagagcaaaaggaaaaagaaattggctggaagagtggtggctgaatgttgcctatctggatgttcgtataccatcacaattgaatgtcaactttgcgggtcctgcagctcattttgaacactactggcctccaaaggaagggactcaattagaaagaggaagtataactctttggcataacttgaactactggcagctattaagaaaagaaaaagtgcctgttcataaagttggaaatactcctctagatatgaatcaattccgaatgctattttctacctgcaaggttccaggaattactagagactccattatgaattattttaggactgagagtgaagggcgttccccaaaccacattgtagtgctgtgtcgaggccgagcttttgtctttgatgtaatacatgaaggatgtttggtcaccccgccagagcttctcagacaactgacatatatccacaagaagtgccatagtgaacctgatggacctgggattgcagcattaactagtgaggagcgaactcgatgggctaaggcacgagaatatctgattggtcttgatccagagaacttggctttgttagaaaaaattcagagtagtttactggtatattccatggaggatagcagtccacatgtaacaccagaggattattctgagattattgcagccatccttattggagatccaacagtacgctggggtgacaaatcctataacttgatttccttttctaatggagtatttggctgtaattgtgatcatgctccttttgatgcaatgattatggtgaacatcagttattatgtggatgagaaaatttttcagaatgaaggaagatggaagggttcagagaaggtacgagatataccacttccagaagagctcattttcattgtggatgagaaagttttaaatgacatcaaccaagctaaagcccagtatctcagggaggcatctgatctacagattgcggcttatgcctttacatcttttggcaaaaagctaaccaagaacaagatgcttcacccggatacgtttattcagcttgcacttcagctggcctattacagacttcatggacaccctggttgttgctatgaaacagctatgacaagacatttttatcatggccgtacagagactatgcgatcatgcacagttgaagcagtgaggtggtgccagtccatgcaggatccttctgtcaatcttcgtgagcggcagcaaaagatgttacaagcttttgcaaagcataataaaatgatgaaagattgttcagctggaaaaggatttgatcgtcaccttttaggtctcttactcatagcaaaagaggaaggtcttcctgttccagaactctttacggacccacttttttccaaaagcggaggaggtggaaattttgttctctcaacaagtctggttggctatttacgagtccagggagtggtagttcccatggtacacaatggttatggatttttctaccatatcagagatgacaggtttgttgtggcctgttcagcctggaaatcctgtcccgagactgatgcggaaaagctagttcagctgactttttgtgcttttcatgatatgatacagctgatgaactctactcatctttagagatgaatcatctattaagcacttaccaaaacatatcattaaactgagtgctgggagtgagttggtaatatgagatgggaaggaatgttgacttgctaacattcctttaacaagttaagaaaacttgttaaatgtagaaattagtagaatcatgctctctaaatttattctgccatagaaggtagaaatatttttaagctcctctgatgcagcagcaatgcaaattatgacatagtgaatatagaactatgcagtatttaagcctcaacaatccaaatctacaaactttaacaatgcaagtcttactctaatttttaagtatttttgttggtacttacatgggttataaatcctctctctggacatcaatgtagagtccatctttcaagcactttaatttttttagctgccaaagggtatgaattacattattgtatgctaatttccctgaaatcaatgccttctatgttcaccacagggatacaagcctgttatgtttgatgggaaagaccactacaatctaatggtgatctaaaataacttttttgggctgggtgcagtggctcatgcctataatcttagcactttgggaggccaaggtaggaggattgcttgaagctaggagtttgagaccagcctgggcaacagggtaaggtcctgtctctacaagatcaaaaacttagccgggtatggtggtgcatgtgtgcctgtagtccaagctacttgaaggctgagacaggaggatcggttgagcccaggaggttgtggctgcagtgagctgtgatgtgcccttatgctatagcctgggcaagagcgtgagaccctgtctcaaagaagaaaaaaagagaaaaataactcttttgaacaaacagacaaattagctagtagtatggagatgtataccctctattacacacataaaaccgtaacaaaattcattgtggtgtattataattagttttgtgaatagaaaaataaagcacttatgtttaaatttgttacagtgacttttaaaggattaatgttgaatcacattgtcagaattttttcctcctcgctgttcaattttgtagtttttactctcaaaaaatgaaattctcaaaattatatagctttttgttttgtttgaataaatgattcattcctg

SEQ ID NO: 335741 - DNA, 1426 bp, Homo sapiens
ctttgaggcccaagggggagcgagccggtgctgctgcaggctgaggctgcggcagaggcggcgaggcgcgggcggtgaggacggacagtcaccgacttagtccagttccctgtgatctcaaaacaattgttgcagcaggctcctggcagtctcaagcagttcatcttcttggtgtactggtttcctattgtgattttatcatggaaaatcaattggctaaatcaactgaagaacgaacatttcagtaccaggattctcttccatcactgcctgttccttcacttgaagaatcattaaaaaaataccttgaatcagtgaaaccatttgcaaatcaagaagaatataagaaaactgaagaaatagttcaaaaatttcaaagtgggattggagaaaaattgcaccagaaattgcttgaaagagcaaaaggaaaaagaaattggctggaagagtggtggctgaatgttgcctatctggatgttcgtataccatcacaattgaatgtcaactttgcgggtcctgcagctcattttgaacactactggcctccaaaggaagggactcaattagaaagaggaagtataactctttggcataacttgaactactggcagctattaagaaaagaaaaagtgcctgttcataaagttggaaatactcctctagatatgaatcaattccgaatgctattttctacctgcaaggttccaggaattactagagactccattatgaattattttaggactgagagtgaagggcgttccccaaaccacattgtagtgctgtgtcgaggccgagcttttgtctttgatgtaatacatgaaggatgtttggtcaccccgccagagcttctcagacaactgacatatatccacaagaagtgccatagtgaacctgatggacctgggattgcagcattaactagtgaggagcgaactcgatgggctaaggcacgagaatatctgattggtcttgatccagagaacttggctttgttagaaaaaattcagagtagtttactggtatattccatggaggatagcagtccacatgtaacaccagaggattattctgagattattgcagccatccttattggagatccaacagtacgctggggtgacaaatcctataacttgatttccttttctaatggagtatttggctgtaattgtgatcatgctccttttgatgcaatgattatggtgaacatcagttattatgtggatgagaaaatttttcagaatgaaggaagatggaagggttcagagaaggtacgagatataccacttccagaagagctcattttcattgtggatgagaaagttttaaatgacatcaaccaagctaaagcccagtatctcagggaggtatatttttcacttttctcttaaataataatgattttttcttttaacaaccatat

SEQ ID NO: 335742 - DNA, 608 bp, Homo sapiens
tgggaggctgtgtaaataagaactttggtccctgggccccggctgtttatccattggcaactgatttccctctctggccacttcctcctgcacagagtttggcctgcctgcgtttccaaagctttgtttatactcttatttgggatatggagcctccatgggaaggaatgggtgttttggacgtgagaaaaaaaaaaatatttttcttcaggcaccaaaccaacatgtagctcaaatgaccagcccttttattcctagtcaataagctatgtgattagagatggaaagggggcaaatggaagagcagatactcatgtgagctaatctgtgagggtagggaagacttttccatgggttttctctctttctgctataaacgcttttctcattctcacactagctttagactaaagggaagcaatactgggtgagaggtggaagcagacgtaggcagagaaggcagtcaaatgctcattgcaaagagatgggaagattaaacactaacctcaggatagtgcttataccttggcagtgctggtaatggggtggggggctgggggagtgggagagaaagggtatgtgatcaaggaaagatgcccaagggggca

SEQ ID NO: 335743 - DNA, 514 bp, Homo sapiens
taggcaactatgtaggaatagttttcatggtactctgtctcataaatatgccccatttacaagaatcactgctctcagggaagcccccagatgtcacttcttatcagatgtcttaaaattttccagtcccaatagcaagctgccttgtgttataattgacatattgtcttaccagattaccagggttacagaattgagagagttaacagaagatcaaattctcatgtaaaagggaaaagctttgctcactgtttatccacacctgtacgttttattgtttttatttgtggtattcctgactgtgataggctaaataatggcccccaaagatatatccacgttctaacccctaaacctgggaatgttgcctttatatagaaaaagccttagcaggtgtgattaaattaagaattgtgagatggaggattatcctggattatctggtggcccctaaatacagtcacatgtatccttataagacagggatttgatgacacagacaaaagggaagact

SEQ ID NO: 335744 - DNA, 275 bp, Homo sapiens
gatgtggggatgtgtgtatgtgtgtatgatccagccacagagtgtcctctgactatgttgtggtaatgatgtggggatgtgtgtatgtgtgcatgatccagccacagagtgtgctctgactatactgtggtaacgatgtggggatgtctgtatgtgtgtatgatccagccacagagtgtgctctatgttgtggtaacgatgtggggatgtgtgtatgtgtgtgtgtgtgtgtgtgtgtgtgttctgtgacctcctgtccccgtggtcccacctct

SEQ ID NO: 335745 - DNA, 651 bp, Homo sapiens
gaaggatgaagcctgtagaaccctttggggtaggtgccagccacagctgaggccagggcactcagctcagcatcttaaggcctttggtggacctggctagggctggccactaggtcccagaagggacctctgatgcaggcccccccgcccccgccgaccacagagacctcctagacttggacatgggtccctcccgtatgatgggacacaagtggaggtggagcagggggccgtgggagcacagagggccccagtccagccctggggttgggaagcagttgctgagatgggtcttgcgggatgagcaggcatcaggggctgcagaagccagcattctaggcagagggacctggaggatgcagggccagcaagataactggcctcgtgttcacgaactattggctgaggtgtggtgtccagcatgtggactgggtagcaaagatgaggctggaggagttggaagtcaaactgagaaatgtcttgggaggcatgctggcagtaagtccagcgcaaaagtgacagggcaccatgtaaggttgtaaggagagagtgacttgcgtgtttgctttgtagaaaggtcactctggttgcatatggagcatggatggagaggggagattagagacagcgtggcccgtttggaagagagga

SEQ ID NO: 335746 - DNA, 515 bp, Homo sapiens
agtggcaaggaggcagagaaagcatctgtacccttacaatttggtgagacaagaatgtatgaattcccacaggtcaaattataatgaagaaaggaacctctcttgagtacaaagagctacctatggtggtctggagccggaggaccacagcatcaaaggatataagatgcatagccaactgaggaacctgagcaattaaagagatccacagttaagtcacacttaactggcacttgtggaagccccgcaaggcctgaaggagagctgacataggcaccccagagagccagaatctggatcccatcttaataaggccatgaacaccagtggagaagaggcagaaacaccaatggataaggaacattcacatctttcttcccatgtgcctctaagtgccagtgcaggccccacaggccaagctacagggagaaaggagatgacgcaaaggaacctaactggactttaatcactagaagtgagaagagaaatctattggaacctcccaagataatgcc

SEQ ID NO: 335747 - DNA, 732 bp, Homo sapiens
aagaggcagaggatgttgacacaaacttacagactgggactccaaggatcagccagatgaaatgctatgtgcagagtcttcatttcccagctcagtggtggacagcagaggactctaagaatcacctcataaatgaactaccttgacatgccctgacccaggctctttatttggaaacccaggctaggacaggaatgaagagaagccagaccttctgactcgaagatccagccacctcttgggatgcacacgtttctcttcaactgcgtgatgtgaactgcgtcacatggtcaaattataatgaagaaaggaacctctcttgagtacaaagagctacctatggtggtctggagccggaggaccacagcatcaaaggatataagatgcatagccaactgaggaacctgagcaattaaagagatccacagttaagtcacacttaactggcacttgtggaagccccgcaaggcctgaaggagagctgacataggcaccccagagagccagaatctggatcccatcttaataaggccatgaacaccagtggagaagaggcagaaacaccaatggataaggaacattcacatctttcttcccatgtgcctctaagtgccagtgcaggccccacaggccaagctacagggagaaaggagatgacgcaaaggaacctaactggactttaatcactagaagtgagaagagaaatctattggaacctcccaagataatgcc

SEQ ID NO: 335748 - DNA, 194 bp, Homo sapiens
aacaacaagaaaaaagtcctttctccagaacaggtagtgtggtgttactcagttatttagttattttagtttctttctttctttctttctttctttctttctttctttctttctttctttctttctctttctttctttttctttttctttccttcctcctttccttttctttctttctttctttctctttcttt

SEQ ID NO: 335749 - DNA, 99 bp, Homo sapiens
cattaggctaaacgctacaaaaaccaacttatggaagaacaaccagaagagtatagtgtttcttagaagattgggagtagttagcagtgttaggtgctg

SEQ ID NO: 335750 - DNA, 154 bp, Homo sapiens
atccctataatttcaataatcctagataccaccaaggcacaggggaaagggccatttcctcattcccatcaaacttttcttgatcaggacaagagctaaaaacccgggctaaatggagatacactgttccaaagtccctatctttgttaacgaa

SEQ ID NO: 335751 - DNA, 389 bp, Homo sapiens
tcctatcttaactagggttgcaacagaaacaatttaatttttactacttgcttatgttcccagcataacacttaagctaatatttaaaaacaactgcttacatattttaaaattatgagtttttaaaactcaggaaatattagtaactcattaacttacatgagtttgaaagacataatttgacaaatcaaatcatctgcagctgatagacttaatcccttagcactctcattttctcattttctatttctctcttaatattgttgccttctagtataaagacagacaaaccgatggaaacatgtatcaatatcaatctctccctgaactaactataagcagacatggtaagcttatctgagattaaactgtgtattccctctaaaaag

SEQ ID NO: 335752 - DNA, 330 bp, Homo sapiens
tgtacttctacaataagagcttcttgcacaggcaggaccaggtcaaaggaagaggacactgatgagggcctggaggctcttacgttgcagattagattaggaaaggccttgaatgccaaactgaggcctacagacttcattacgcaaggtaaacagttgagagaagcaggatgatccaagttgtgctgtagttaagtgtgctccagggcaaactggagtctggatgggagaatggaggtggagatgtaactgccataactaggcatgtagggctaagaaactgttctgggatggcagcctttgggactagaaagaagggatgcacaagga

SEQ ID NO: 335753 - DNA, 142 bp, Homo sapiens
ctggcagcttctatgtacctgcagaacccaaattggcatttgtcatcagggtcagaggtatcaatggcgtgagcccaaaggtccaaaaggtgttgcagcttcttcgccttcatcaaatcttcaatggaacccttgtgaagat

SEQ ID NO: 335754 - DNA, 181 bp, Homo sapiens
aggatacagtatgcccttttgtatttccaagagtgcattttttaaaaactgcccttcctttcctccattgttacacagagaatgtaactaatactttcttctgagaaacagccttctcctgaagtgatagccacacctcaccgccacccaacaccaccaccgagtatactgcccctcttcc

SEQ ID NO: 335755 - DNA, 625 bp, Homo sapiens
acacaggcacagctgctggggccatctcagcacagacctgggcaatcacatcctcatccctgggagaccccaggcctcctctgctcccacacttcaggactatctattcactgcaaaggacaccccactcaatcctcagtacttctcacacaccatgctctttctagcctcctggcctttgcaccacctgtgctgatctgacacgcttcaccttctctctaaagctgtcaccaagctaaggcctgcctggcctcagatcctgactgtcccctgagtatccacaggtagggtggtttaggtattcctgcctggctctgggcttcttgtcacatgctcacccgcctttgctttcttactggtccacagcctgtcccccatgacgttagccccattaggacaggaacttttcccattaggacaggaaccctaactctgagcctaacctctgtgaggattcatgaatgcaagaaaaattcgcttcaacaaattctaagagagtttccaaatctgttactgggaggagctttgctacaaaggtgttctgtgatttgcacacaaatattcatagcagcattattcttgatagctaagaggtggaagcaacccagatgtccatcaatggatg

SEQ ID NO: 335756 - DNA, 457 bp, Homo sapiens
cccagcaggtctctgggtgatgcctggtgtaagtcatctagtcagtgcagggagatgtgggtatgcaaggagaaggcagggctatgtggtccaaataggactgactgtgaatgggcaattccacctagaaggggaattaaaagtaataatgttgctgccgagcctgtctggtaccacacactgtattggacatacagctctgttaagttcctactcttaaaagagaagtaactaactgaatgccttacctagaatgggtttaatagataaggttggcaaatggcatgtatggggaggagagaagagtggaatctgcaaaggaaggaacctatacagcctttttactattagccttggcgctgaagcatgagctgtgtcccctgtatctagttctaatagaacagtattgagaagcttcagacattcaacttttcagtggcatttagggaaagctaaa

SEQ ID NO: 335757 - DNA, 509 bp, Homo sapiens
acagctaggaagtagctgaataagaacccaggttagacctttcacttcaaaatccatagaaagtgtaaaagcaacgtgaaggaagcaatcaacactgcagccaatttctgctgtttagtgctcaacacctctctcccttcttttgtgtatctggtggcactgtggagccctaatacctggagccactcctggcacagggatgggcaagtgagttaggcctgtccacccaagtactctacccttttggctgctccaaatgccgtcatgtagcccaaatgggattacacaaccctcccctatgatatattcataaccaactgactggaagaacaaaattaaaaaaacaaaatgtgagtaatgtattgaaaaatctctccattaaaaaaagtgaaaacaaatatacaggttataaaatatttttaaactatttttaataatatccaggtctatttttatccttttaaaattctaggccgggcacagtggctcacacctgtaatctcagcact

SEQ ID NO: 335758 - DNA, 438 bp, Homo sapiens
aggcgcccaccaccactcctggctaatttttgtatttttagtagagatggggtttcaccatgttgatcaggctggtctcaaactcctgacctcatgatctgcctgcctcggcctcttaaaatgctgggattacaggcgtgagccactgcacctggcctcaagcagtaatctttaagcatgtttagccctctgtgagtaatttctctttattaggtcagcaagtgaattcatattagaatgtggtttaagaatacaaatttccagttttagtaaatgtgctgctgaagcgagcacaagaatacaaattccataaagatcattataagacaaagtgggaggaacattttcaaaaaggttttaagtctttttttttttttaaataaaattcagggttgcctttcagttgataattgatggaggcgatcagaactcacttcc

SEQ ID NO: 335759 - DNA, 638 bp, Homo sapiens
  misc_feature (638)..(638): n is a, c, g, or t
caggatgttctgctctgattggcagggagagtttgaaggtgggttggcagagactgtgaccgcaactgactgcgttctgcagaattatggtaatgaaattggaagccaactttcgtgaagcagaaagcctcaagtttccaggtgctgtgctcagtccaggaatacaatgatgaatacgatcaaggcccttatttcagagctgacacacactatacataatgcatcaaaaattgcgttctcgctatatttctgtttatttggttttatctgcaagaatatagatagcatctgctttgatataaaacttttatgtgtcttatgtagttgatttgtaaatgtcctatctataaatataaaacaataaattactagttacagttaacttaggaaaacttttaatcatgtcctacattttacaccttgtaatttctaccaaatgtttgtatttttatgtcttattaaatataataaatatttgtcttaacatattttaatagaattcctcatatgttttgcagaaagctaattatggttttccatgtgatttttctttcatatatacagtattatttaaaataaatttgtataaaataaaaatctggcctcgttggcctcagcggtggagctctcggccggan

SEQ ID NO: 335760 - DNA, 487 bp, Homo sapiens
caggatgttctgctctgattggcagggagagtttgaaggtgggttggcagagactgtgaccgcaactgactgcgttctgcagaattatggtaatgaaattggaagccaactttcgtgaagcagaaagcctcaagtttccaggtgctgtgctcagtccaggaatacaatgatgaatacgatcaaggcccttatttcagagctgacacacactatacataatgcatcaaaaattgcgttctcgctatatttctgtttatttggttttatctgcaagaatatagatagcatctgctttgatataaaacttttatgtgtcttatgtagttgatttgtaaatgtcctatctataaatataaaacaataaattactagttacagttaacttaggaaaacttttaatcatgtcctacattttacaccttgtaatttctaccaaatgtttgtatttttatgtcttattaaatataataaatatttgtcttaacat

SEQ ID NO: 335761 - DNA, 880 bp, Homo sapiens
  misc_feature (880)..(880): n is a, c, g, or t
gtgaatcaggaccagtgcaataaatcaccctcaatacttcctgtgaatggcaactgctgaagggaagcttctgcctctcatcatacactgcctcaggggggaacaaaatagatcattacaatggaggccaaagagtgcttgaatgtctctgccgaaggctttcaataaatatttgttgaaaaagaaaggaagaaagaaaatgaagaaggaacgaaggaggaaaggaaagaaggaaagaaggaaggaaggagttaatgaagactcaagggagagtttgaaggtgggttggcagagactgtgaccgcaactgactgcgttctgcagaattatggtaatgaaattggaagccaactttcgtgaagcagaaagcctcaagtttccaggtgctgtgctcagtccaggaatacaatgatgaatacgatcaaggcccttatttcagagctgacacacactatacataatgcatcaaaaattgcgttctcgctatatttctgtttatttggttttatctgcaagaatatagatagcatctgctttgatataaaacttttatgtgtcttatgtagttgatttgtaaatgtcctatctataaatataaaacaataaattactagttacagttaacttaggaaaacttttaatcatgtcctacattttacaccttgtaatttctaccaaatgtttgtatttttatgtcttattaaatataataaatatttgtcttaacatattttaatagaattcctcatatgttttgcagaaagctaattatggttttccatgtgatttttctttcatatatacagtattatttaaaataaatttgtataaaataaaaatctggcctcgttggcctcagcggtggagctctcggccggan

SEQ ID NO: 335762 - DNA, 337 bp, Homo sapiens
cctagcttgcctggtggcacccacaaccggccctcagtgtccacttctgagtttagcctgggcaagagactggtccataaacgacttcctgcccagtggtaaacagtggaaggcaggctcctgtgtttctcgtggttggtggtaatcgctgcttttgcaaagtggcttttggggaggagaggttttaggaagtgtgttaaatgaggggggaagtgttacttgggggtttcccagcactcaacacgcacactgcaggggctgccctcccccgcagcacactgggagagcctgtcctccagcgctgcccacgcccggccgtgggtctcattccccactg

SEQ ID NO: 335763 - DNA, 99 bp, Homo sapiens
ctgggaaaggccaactcctgaggatggagctactttagaaaacatggttagaaaattctctctgggcgtggtggctcacatccataattccagcacttt

SEQ ID NO: 335764 - DNA, 215 bp, Homo sapiens
gtaaattgcccagtttggagtatgtctttatcagcagtgtgaaaacagactaatacacttcctataacacaattctgcaaggatagtctaccaatacacagaccttcaattcaacatgcacaaagcaccatcttcctgaccccaactcccaatcactcaggttcacaacttcaacctgacttaagactctctttttttttttttttttttttttt

SEQ ID NO: 335765 - DNA, 624 bp, Homo sapiens
taaacacctacattcagaaaaaaagaaagatctctaatgaacaacctaactttacacctaagcccaaagttagcagaaggaagaaaataaagattagaacagaaataaatgaaatagatactagaagaacaaaagaaaatatcaacaaaactgagataataaaaacagagaaaagactcacataaataaaattatagataagggagatataacaactgatatcacagaaatacaaaggatcataagagactactatgaaaattatattccaacaagttggataacctaaaagaaatgaagaaattcctagaaacatacagctgactatcttagtttgttttctgttgtttataatagaatatctgaaactgggtaatttagaaagaataggaatttattttctaccattatggaggctgagaagtccaggatcaagggggtgcatctgatgaaagtctccatggtggggactctgcagaattctgaagcagtacagcgcatcacatgaccagggtgctgagcatgctaggtccaatctctcttcttcttataaagccaccagtcccactcccatgataacccattaatccattaacccattagtagattaatccattcacaaag

SEQ ID NO: 335766 - DNA, 335 bp, Homo sapiens
aaaatcattattgtgccctctttgctacattatgttttctgctttgagtagagctcttactgatgctttcaggtcttctcctcacctgtttttttcaccttcttcctcattgtccatgggtgctgccgaaatttactaatgtataaatgctccatctccacctccttacactgaaaagacaactttacctattctacagagaaaatataggctagtgtgccacccccctccaattttaactatttttctacgcttttttttttttctttgagacagagttgtccaggctggagtgaggtggcaccatctcggctcactgcaacctcagcctccca

SEQ ID NO: 335767 - DNA, 335 bp, Homo sapiens
ttatctttttccttcaaagctcgggggttagacacttcatagacaaggaacccaactgcatatccataaaatagaagaatttgcgtacaccttcctgccttaaatcctggtgctcatttctcttccttactaataaatgtcctttgtgacattttttccaaaacaggtcactttcatcagcattaaaagcttgttcagggctgctctgcctatggtgtagccattcttttattcttttgctttcttaataaacttgcttttacaaaaaaacacccactcaggaagatatatttaatactttctcctcaatgattttctgaatggtgtttgggaac

SEQ ID NO: 335768 - DNA, 143 bp, Homo sapiens
caaaaattatagtagtttggagatatttcacaatataaggtcaataatcctacaagccatgagagttcatcctacaaatgccattttagtataatgaggcatcataaggatactgaatcattcataaaaggcaaattacattg

SEQ ID NO: 335769 - DNA, 284 bp, Homo sapiens
gtccttcaacctcatgtacttctcgagtcactgtgtcacccaagttcaaatcttctggtgtcctaatgctgcctgtgaaagtaagaactccttagtagactacacaatgccctccacaggagcacggacagtgagctcttgggaccacacaaggccatgacctgacccctagctgtctttccagttttaccttcctctgctcccagctcctttgggacttaacatatgctctcctgcagtatatataatacaccagaaattatgtgcattttagaattagataa

SEQ ID NO: 335770 - DNA, 482 bp, Homo sapiens
cccatggtgccaaacccatatactctcctatcctcaataccttcctccacaactcactattccattcttgatgttaaagatgcttttttcactattccccttcaccccttatcccagcctctctttgcttttacctggactgacgctgacacccatcagtcccagcagctgtactgccacaaggcttcagggacaggcctctttacttcagccaagctctttctcatgatttactttatttccacccctttgcttctcatcttattcaatatactgatgaccttctactttgtagcccctcctttgagtcttctcaataagatatcctcctgctccttcaacatttactctccaaaggatatcaagtatccccctccaaagctcaaatttcttctccatcggttacctgctttggcataagtcttcatgaaaacacgtatgctctccctgacaatcgcgtccagctgatctctcaaacccca

SEQ ID NO: 335771 - DNA, 515 bp, Homo sapiens
agctctctggaagtctgtggcgtcaggtctcatcttggcgacaggatctgtcccgctgctgattctggggatgtgtttagaagtggtcatgaggatagagatggggaccatgagaataagccaagcaaggccatcaccaccatcactgccaagctacacgaattactgacaaacttcaagtctgacacccactgtgctcacgaagactctatcttataggggataaagccgcccctatatccacagccaatgcacagtgactcaggcacaccacctagtaaaatactgaaatacctccagtgagtctagatccacagccccacctccacaggtccagctccaccactaatctctggggtctctccctagatctgccacccaccccgcagaatgactgactgcccaggatccatccagccaatgattgactcttctttttttttttaagacatagtctcgctgtgtcacccaggctggagtgcagtcacgcaatctcagctcactgcaacccccac

SEQ ID NO: 335772 - DNA, 559 bp, Homo sapiens
agcactaggttcccgcgagataaagcttgctgaccacaagacacccttgttcctaggaggggagttcagggccattgcaaagcacaggaggcatttgtccaagtggactcagccccatgtgcctttcaccctgaggcccagggactggggacaggaccccaggcaggtagtgccctgatctcctgctcagagataatgctactctgggtgtgtgggacagagtgtgggaaaaatggagagtctgacaacatgtatgcttggcacttcccttctgtttctttgtcctccttcacgttttctgaatgttgaccaagtgcctactcagacccagggaaaatgaaaggcatttaggggagagacgagaggcacagccctgactattgaagggttccggcctcaggagggagcagatagagcagtggcccatcacaggtcatggccatatgtgctgggtgagaggcatgagaaaaaaacctctgaccccatattacttccttcctgttcccctaatctgtcctcgctgatcttcagtgtcccaagagaggattggcgacttgct

SEQ ID NO: 335773 - DNA, 562 bp, Homo sapiens
aaacttttgaatcatccttgctacctccctctccatcaaccatatccaaataatcaccaccttcttgctgattttaactacaaacccaatctcactcaatctcaatcctcacctgtcattaagcgttatccagtgctgctacgccatcactggttgactgcaaaagcactgtttgttcacatccaccctcctcctccccagggtggccacatgattgcacaggctgtgcctgcgtaacaagtctggctcagggggctgaagccttttgacctggcctagctgggacacagtggtgcattttttctaattggtccacacagaatagaagcctttcttgggtttgcacaaagacaccaaacgtgccagcaggacctacctctctaaactattctctacacagcaacagcgatcattttacaaactcaaattaggccaggtgcggtggctcacacctgtaatcctaggactttgggaggccgaggtgagaggatcacttgaggtcaggagttcaagaccagcctggccaatatgctgaaaccccgtctctactaaaaatacaaaa

SEQ ID NO: 335774 - DNA, 156 bp, Homo sapiens
gatggaatgtaggttttatcccctaaggaatttgatctattgctattgccttcctggagcatcctgttgagaagatgcaggataaagattgctgagactgataagtgatttctgcctttagcaagggacctggggcacttttagcagttatttgcc

SEQ ID NO: 335775 - DNA, 304 bp, Homo sapiens
tggcgcgaggacttctgagtggggaacaattccagagctgaggaaggtgccaggctgggcgtgcaaggacaggaggagccccaaacaggcctcggagtaaggagctagggtggcaggtctcagcctccaggctgagtggggacagcagcagagtcatcttgaggctggtgcagtgagacagggtcctaaggccagagcaccaggacgatgccctgggagcggggagtccgcctcgcacccttctcagaagaaatgctatcaagcaacagctccctccactccacatcacagaaagacccctgcc

SEQ ID NO: 335776 - DNA, 875 bp, Homo sapiens
gacatgtctctctcctgtgctaaacaaaagtgtgaagcatttgcaagctgtgacaaaggtgtctttagttgcacttgcttgaccctaacctagattatttccagaaatacttttaaggaattctgtagagaggacatctattagtggaaagattttgggggctggtacacatcccctgtttgtgttttattgtcttcagtgtgggccgttggtccttatagttagcagagtggaaactgcagcaggctgcaagcaggctgacacagttagttgttcattaacttacctttgaggagaagccagaggctgacagctcagggaatccactcaggtgctataggggcaaggaagaaggaatatttaatgtatctacttaatagtgaaaggcatgcattttatgtattattgaaataactgctaaggtcctattttgaatttgaagactaagagggagggatgttctttatttcttatagatggaatcaaatttttataaacatgaaaggagtatagcgattgtaacaagacttcttgccatggttatttggagctattaagattaactgccttttaaagagtgggtatttttctgattttcaatattagtttgtggctacattcctttttctactgcaagaatgtttgctctcctttatgaaaagttcaagttggtggagaaactaaatgttttgtacataagtatataactttcttcattcaggaagtagttactgagcgcctactgttttggcttttgtaccaggagtctataaattaatcgttttccacctggcaagtagtctcattggcaaaattttggcttctttatctgtttaaactagatcaaaataaagacagttaaaaggtgatgcact

SEQ ID NO: 335777 - DNA, 914 bp, Homo sapiens
gacatgtctctctcctgtgctaaacaaaagtgtgaagcatttgcaagctgtgacaaaggtgtctttagttgcacttgcttgaccctaacctagattatttccagaaatacttttaaggaattctgtagagaggacatctattagtggaaagattttgggggctggtacacatcccctgtttgtgttttattgtcttcagtgtgggccgttggtccttatagttagcagagtggaaactgcagcaggctgcaagcaggctgacacagttagttgttcattaacttacctttgaggagaagccagaggctgacagctcagggaatccactcaggtgctataggggcaaggaagaaggaatatttaatgtatctacttaatagtgaaaggcatgcattttatgtattattgaaataactgctaaggtcctattttgaatttgaagactaagagggagggatgttctttatttcttatagatggaatcaaatttttataaacatgaaaggagtatagcgattgtaacaagacttcttgccatggttatttggagctattaagattaactgccttttaaagagtgggtatttttctgattttcaatattagtttgtggctacattcctttttctactgcaagaatgtttgctctcctttatgaaaagttcaagttggtggagaaactaaatgttttgtacataagtatataactttcttcattcaggaagtagttactgagcgcctactgttttggcttttgtaccaggagtctataactttcttcattcaggaagtagttactgagcgcctactgttttggcttttgtaccaggagtctataaattaatcgtttgccaatgagactacttgccaggtggaaaacggtcgacgcggccgcgaatttagtagtagtagta

SEQ ID NO: 335778 - DNA, 208 bp, Homo sapiens
gatgacagatcatgagataatacatgtgcagcatttcagatcagtagagccctaggcagccattggttgccataggcagccatgagttgagaaggccagtgccacaggagcacaggggcctaagaacgctggccatacgtgctagatgctgacaaagaccaggggaaagcagagtgtgactgggaccggcacaggaaagggtggctaa

SEQ ID NO: 335779 - DNA, 6011 bp, Homo sapiens
  misc_feature (2924)..(2924): n is a, c, g, or t
  misc_feature (2938)..(2939): n is a, c, g, or t
  misc_feature (2980)..(2980): n is a, c, g, or t
  misc_feature (3021)..(3022): n is a, c, g, or t
  misc_feature (3207)..(3207): n is a, c, g, or t
  misc_feature (3246)..(3246): n is a, c, g, or t
  misc_feature (3264)..(3264): n is a, c, g, or t
  misc_feature (3279)..(3279): n is a, c, g, or t
  misc_feature (3287)..(3287): n is a, c, g, or t
  misc_feature (3317)..(3317): n is a, c, g, or t
  misc_feature (3319)..(3319): n is a, c, g, or t
  misc_feature (3334)..(3334): n is a, c, g, or t
  misc_feature (3345)..(3345): n is a, c, g, or t
  misc_feature (3397)..(3397): n is a, c, g, or t
  misc_feature (5437)..(5437): n is a, c, g, or t
attgaacacaaccatgactcaggcactgggctaggtgcttgggatacatccgtgagccacacaaagttccccaccccagaggagctcttacctggcccagaatctggatctctgcccccagcccctatcctcaaggtagagtcccaaagatgtcctaaatctcacacaggctgagttgtgcttaatccatttctgcagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggcgtggcctcctactgccgtccctgtgccctagaagcctctgatgtgggctcctcctgcacctcttgtcctgctggttactatattgaccgagattcaggaacctgccactcctgcccccctaacacaattctgaaagcccaccagccttatggtgtccaggcctgtgtgccctgtggtccagggaccaagaacaacaagatccactctctgtgctacaatgattgcaccttctcacgcaacactccaaccaggactttcaactacaacttctccgctttggcaaacaccgtcactcttgctggagggccaagcttcacttccaaagggttgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcagatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagcagccagctcctgtcaccatctctctttcagaggactcctgatggatttgactcagtgccgctgaagacatcctcaggaggcccagacatggacctgtgagaggcactgcctgcctcacctgcctcctcaccttgcatagcacctttgcaagcctgcggcgatttgggtgccagcatcctgcaacacccactgctggaaatctcttcattgtggccttatcagatgtttgaatttcagatctttttttatagagtacccaaaccctcctttctgcttgcctcaaacctgccaaatatacccacactttgtttgtaaattaaaaaaaatgcccttgcttgtatcttgtttcccaaaatggcccatccgccagagccatagcttcgtctgctcataattcttatagctttggaatgaaaatatttctatcttcttaagtatagaaactatttcctctgtcctctaacttaagggcagaaacagctgggagttttcctcgcatgccctcagctcatgatctcttcaggagagaggctgggtgaggagggtgtcggggttccctggtggataatcttcatagcagcctggatccatttcccctggataaccagctcaaagggagtgaaaatggtagtctgagggcaaggggagcaaggcctgggtaagaaaagccttgaaaagcataaaaagaggccgggcgcggtggctcacgcctgtaatcccagcactttgggaggccgaggcgggcagatcatgaggtcgggagattgagaccatcctggctaacacggtgaanccccgtctctactnnaaatacaaaaaattagccgggcgtggtggcgggtgcctgtngtcccagctactcgggaggctgaggcgggagaatagcgtgnncctggaaggcggagcttgcagtgagccgagatcgcgccactgcactccatccagcctgggtgacagagtgagactctgcctcaaaaaaaaaaaaaaaaaagaaaagcacaaagagaggcaacaaggaatgtttttgtttttgagacaggctctcactctgtcacctaggctggagtgcagtggcntaatcactgttcagtgcagcctcaagctcttgggctcangctatcctcccatctcancctctcaagtagctnggactacnagtgtgcaccaccaggctcactaatttttntnttttttgtagacacngggtttcaccntgttgcccaggctggtctccaactcctgggctcaagtgatctgtccgcctcngcctcccaaactgctgggattacaggcataagccactgcactcagccttttatttgttttttaaaccacgtagctcattgccttctcttaagtaaatgatagatattctcactgaagccaaaggaataagttcatcaagaaaatgcccaaagccctggtggatacatcctccctatcttttttttaaaccttccactatcactctatgacactgaaaagaaccaggtaagccccaaacccagatgttccagccttatcctctattgggtttacccacagacatagcaaaccctgtcagtgaggaaaattccccatccttgagtgcccccgtcctagaagtttgggccatattatggaacaggggtctcttatttgaaaagagcacaaggaggccaagattttaatggggcactttaggggatacagcccacaatggcatgggcctgaggtggccgtgatgtctgcttctaagcttaacgcatctgctcaggcacagaataaacgtctaggctggccaaaaaaggaactgaatcccaggcccatacgccagcaccagaatcaaaccagtcttcaaggaaggaaggctaggagagtttaacaagattttcactgggcccagcatggtggctcacacctgtaatcccaaggcagaatggtggcttgagctcaggagttcaagaccagcctgggcaacacagtgagaccctgtctctaaaaaatttaaaaataaacaaggtgttcaccaagctgggatacttctcactattaagcccctatctttctctttttttcattctcaattgctttgtgtgataaaaaactaaagagacttctggtccaatttctggcaacatcccttctgaaaggtgagtagagtgggtgtcttctatgcccattttccccaattttacacaaactattatcaatgaacttttaagtacctagaatgggtaaaaccagagcaagactttaaattaccttcttctttcttctactggcagttctgcctccatcactatcaggctagggtgaccttcccttggtcaagccccaattgcccatgatttgtgcctgtgccctttctccagtgaccatttggtgaccagatggtagatatagaaaggggatggcatttgcaagtgactagtctgccacaaaatgctcatctgattagccactgctgccctggcaatggctttgtaagagtcaatgagaactagagccaggctgtggtccctggccatcaacagtgttggtgacggcagggagtccctttggtttaataaatccagtttttctttgggtatccaaattctcccctccttttgtaggagtcaggctctcagaacctgtgtccatgttggaacttcccccagtgtggatgcagatacgcagctcctgagctccagcctaaagtcttctgtagcctcagcaatacttgggcacctgctgtctcactgaatagctttcttttgtgacaaaggccacagacagcccttagactattccggaaacagtaggaaaaattacatatgtctttgacttctttattctgactccactgattttagccataatactttaaggagctactttttactaccccttaccgtgctgacttctgcaggtctgccctgtgacctgtcaggaactcctgagttacgctactggggtcacctgttgctcccctagcaagttaggcatgtcatatatttttaacagctttattgagatataattcacatattatacaattcacctttaaaacatacgattcaatggttttcagcaaactcacagagttgtccgcccacttgagagcaaacacatgttcaattttcttttcctttttttttttgagacagagtcagctttgttgcccaggctggagtgcagtgccatgatcttggctcactgcagcctccccatcctgggttcaagtgatccttctgcttcagcctccccagtagctgggattacaggcatgcgccaccacgcctagctaatttttgtgtttttagtagagatggggtttcaccntgttggccaggctggtctcaaactcctggactcaagtgatccacccacctcggcctcccaaagtgctgggattacaggtgtaagccaccgtgcctggcctacatgttcaattttctatgaacaaaggctttagtccttgacccagggctaaagtggtctgtccaagctgttgttggtagagggagtatgataaaatgtttaaatctcatttggttaccttgagtcctggaacacgcagtaactgtcatgctatagtcatcatctgtatttggctgggaatacaaatgaagattgtggtgtattcaagcagtagggtttttgcttttgtttttgttttagtgccaacaaaacttttttttgtctgactacattaaagataagactgactatatttatacaacagaaactttgtaatagattttttcagctttgtgaaatcgaattttttttcatcagggctggttggatttcctttttaccctgtaatccaagcgttaatagtttgttagaagatgggttattgcatgtcactttttttttttgtaaaataaaaacataccttacaaaaaaaaaa

SEQ ID NO: 335780 - DNA, 5980 bp, Homo sapiens
  misc_feature (2893)..(2893): n is a, c, g, or t
  misc_feature (2907)..(2908): n is a, c, g, or t
  misc_feature (2949)..(2949): n is a, c, g, or t
  misc_feature (2990)..(2991): n is a, c, g, or t
  misc_feature (3176)..(3176): n is a, c, g, or t
  misc_feature (3215)..(3215): n is a, c, g, or t
  misc_feature (3233)..(3233): n is a, c, g, or t
  misc_feature (3248)..(3248): n is a, c, g, or t
  misc_feature (3256)..(3256): n is a, c, g, or t
  misc_feature (3286)..(3286): n is a, c, g, or t
  misc_feature (3288)..(3288): n is a, c, g, or t
  misc_feature (3303)..(3303): n is a, c, g, or t
  misc_feature (3314)..(3314): n is a, c, g, or t
  misc_feature (3366)..(3366): n is a, c, g, or t
  misc_feature (5406)..(5406): n is a, c, g, or t
attgaacacaaccatgactcaggcactgggctaggtgcttgggatacatccgtgagccacacaaagttccccaccccagaggagctcttacctggcccagaatctggatctctgcccccagcccctatcctcaaggtagagtcccaaagatgtcctaaatctcacacaggctgagttgtgcttaatccatttctgcagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggcgtggcctcctactgccgtccctgtgccctagaagcctctgatgtgggctcctcctgcacctcttgtcctgctggttactatattgaccgagattcaggaacctgccactcctgcccccctaacacaattctgaaagcccaccagccttatggtgtccaggcctgtgtgccctgtggtccagggaccaagaacaacaagatccactctctgtgctacaatgattgcaccttctcacgcaacactccaaccaggactttcaactacaacttctccgctttggcaaacaccgtcactcttgctggagggccaagcttcacttccaaagggttgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcagatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagaggactcctgatggatttgactcagtgccgctgaagacatcctcaggaggcccagacatggacctgtgagaggcactgcctgcctcacctgcctcctcaccttgcatagcacctttgcaagcctgcggcgatttgggtgccagcatcctgcaacacccactgctggaaatctcttcattgtggccttatcagatgtttgaatttcagatctttttttatagagtacccaaaccctcctttctgcttgcctcaaacctgccaaatatacccacactttgtttgtaaattaaaaaaaatgcccttgcttgtatcttgtttcccaaaatggcccatccgccagagccatagcttcgtctgctcataattcttatagctttggaatgaaaatatttctatcttcttaagtatagaaactatttcctctgtcctctaacttaagggcagaaacagctgggagttttcctcgcatgccctcagctcatgatctcttcaggagagaggctgggtgaggagggtgtcggggttccctggtggataatcttcatagcagcctggatccatttcccctggataaccagctcaaagggagtgaaaatggtagtctgagggcaaggggagcaaggcctgggtaagaaaagccttgaaaagcataaaaagaggccgggcgcggtggctcacgcctgtaatcccagcactttgggaggccgaggcgggcagatcatgaggtcgggagattgagaccatcctggctaacacggtgaanccccgtctctactnnaaatacaaaaaattagccgggcgtggtggcgggtgcctgtngtcccagctactcgggaggctgaggcgggagaatagcgtgnncctggaaggcggagcttgcagtgagccgagatcgcgccactgcactccatccagcctgggtgacagagtgagactctgcctcaaaaaaaaaaaaaaaaaagaaaagcacaaagagaggcaacaaggaatgtttttgtttttgagacaggctctcactctgtcacctaggctggagtgcagtggcntaatcactgttcagtgcagcctcaagctcttgggctcangctatcctcccatctcancctctcaagtagctnggactacnagtgtgcaccaccaggctcactaatttttntnttttttgtagacacngggtttcaccntgttgcccaggctggtctccaactcctgggctcaagtgatctgtccgcctcngcctcccaaactgctgggattacaggcataagccactgcactcagccttttatttgttttttaaaccacgtagctcattgccttctcttaagtaaatgatagatattctcactgaagccaaaggaataagttcatcaagaaaatgcccaaagccctggtggatacatcctccctatcttttttttaaaccttccactatcactctatgacactgaaaagaaccaggtaagccccaaacccagatgttccagccttatcctctattgggtttacccacagacatagcaaaccctgtcagtgaggaaaattccccatccttgagtgcccccgtcctagaagtttgggccatattatggaacaggggtctcttatttgaaaagagcacaaggaggccaagattttaatggggcactttaggggatacagcccacaatggcatgggcctgaggtggccgtgatgtctgcttctaagcttaacgcatctgctcaggcacagaataaacgtctaggctggccaaaaaaggaactgaatcccaggcccatacgccagcaccagaatcaaaccagtcttcaaggaaggaaggctaggagagtttaacaagattttcactgggcccagcatggtggctcacacctgtaatcccaaggcagaatggtggcttgagctcaggagttcaagaccagcctgggcaacacagtgagaccctgtctctaaaaaatttaaaaataaacaaggtgttcaccaagctgggatacttctcactattaagcccctatctttctctttttttcattctcaattgctttgtgtgataaaaaactaaagagacttctggtccaatttctggcaacatcccttctgaaaggtgagtagagtgggtgtcttctatgcccattttccccaattttacacaaactattatcaatgaacttttaagtacctagaatgggtaaaaccagagcaagactttaaattaccttcttctttcttctactggcagttctgcctccatcactatcaggctagggtgaccttcccttggtcaagccccaattgcccatgatttgtgcctgtgccctttctccagtgaccatttggtgaccagatggtagatatagaaaggggatggcatttgcaagtgactagtctgccacaaaatgctcatctgattagccactgctgccctggcaatggctttgtaagagtcaatgagaactagagccaggctgtggtccctggccatcaacagtgttggtgacggcagggagtccctttggtttaataaatccagtttttctttgggtatccaaattctcccctccttttgtaggagtcaggctctcagaacctgtgtccatgttggaacttcccccagtgtggatgcagatacgcagctcctgagctccagcctaaagtcttctgtagcctcagcaatacttgggcacctgctgtctcactgaatagctttcttttgtgacaaaggccacagacagcccttagactattccggaaacagtaggaaaaattacatatgtctttgacttctttattctgactccactgattttagccataatactttaaggagctactttttactaccccttaccgtgctgacttctgcaggtctgccctgtgacctgtcaggaactcctgagttacgctactggggtcacctgttgctcccctagcaagttaggcatgtcatatatttttaacagctttattgagatataattcacatattatacaattcacctttaaaacatacgattcaatggttttcagcaaactcacagagttgtccgcccacttgagagcaaacacatgttcaattttcttttcctttttttttttgagacagagtcagctttgttgcccaggctggagtgcagtgccatgatcttggctcactgcagcctccccatcctgggttcaagtgatccttctgcttcagcctccccagtagctgggattacaggcatgcgccaccacgcctagctaatttttgtgtttttagtagagatggggtttcaccntgttggccaggctggtctcaaactcctggactcaagtgatccacccacctcggcctcccaaagtgctgggattacaggtgtaagccaccgtgcctggcctacatgttcaattttctatgaacaaaggctttagtccttgacccagggctaaagtggtctgtccaagctgttgttggtagagggagtatgataaaatgtttaaatctcatttggttaccttgagtcctggaacacgcagtaactgtcatgctatagtcatcatctgtatttggctgggaatacaaatgaagattgtggtgtattcaagcagtagggtttttgcttttgtttttgttttagtgccaacaaaacttttttttgtctgactacattaaagataagactgactatatttatacaacagaaactttgtaatagattttttcagctttgtgaaatcgaattttttttcatcagggctggttggatttcctttttaccctgtaatccaagcgttaatagtttgttagaagatgggttattgcatgtcactttttttttttgtaaaataaaaacataccttacaaaaaaaaaa

SEQ ID NO: 335781 - DNA, 3300 bp, Homo sapiens
attgaacacaaccatgactcaggcactgggctaggtgcttgggatacatccgtgagccacacaaagttccccaccccagaggagctcttacctggcccagaatctggatctctgcccccagcccctatcctcaaggtagagtcccaaagatgtcctaaatctcacacaggctgagttgtgcttaatccatttctgcagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggcgtggcctcctactgccgtccctgtgccctagaagcctctgatgtgggctcctcctgcacctcttgtcctgctggttactatattgaccgagattcaggaacctgccactcctgcccccctaacacaattctgaaagcccaccagccttatggtgtccaggcctgtgtgccctgtggtccagggaccaagaacaacaagatccactctctgtgctacaatgattgcaccttctcacgcaacactccaaccaggactttcaactacaacttctccgctttggcaaacaccgtcactcttgctggagggccaagcttcacttccaaagggttgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcagatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagaggactcctgatggatttgactcagtgccgctgaagacatcctcaggaggcccagacatggacctgtgagaggcactgcctgcctcacctgcctcctcaccttgcatagcacctttgcaagcctgcggcgatttgggtgccagcatcctgcaacacccactgctggaaatctcttcattgtggccttatcagatgtttgaatttcagatctttttttatagagtacccaaaccctcctttctgcttgcctcaaacctgccaaatatacccacactttgtttgtaaattaaaaaaaatgcccttgcttgtatcttgtttcccaaaatggcccatccgccagagccatagcttcgtctgctcataattcttatagctttggaatgaaaatatttctatcttcttaagtatagaaactatttcctctgtcctctaacttaagggcagaaacagctgggagttttcctcgcatgccctcagctcatgatctcttcaggagagaggctgggtgaggagggtgtcggggttccctggtggataatcttcatagcagcctggatccatttcccctggataaccagctcaaagggagtgaaaatggtagtctgagggcaaggggagcaaggcctgggtaagaaaagccttgaaaagcataaaaagagtgctgggattacaggtgtaagccaccgtgcctggcctacatgttcaattttctatgaacaaaggctttagtccttgacccagggctaaagtggtctgtccaagctgttgttggtagagggagtatgataaaatgtttaaatctcatttggttaccttgagtcctggaacacgcagtaactgtcatgctatagtcatcatctgtatttggctgggaatacaaatgaagattgtggtgtattcaagcagtagggtttttgcttttgtttttgttttagtgccaacaaaacttttttttgtctgactacattaaagataagactgactatatttatacaacagaaactttgtaatagattttttcagctttgtgaaatcgaattttttttcatcagggctggttggatttcctttttaccctgtaatccaagcgttaatagtttgttagaagatgggttattgcatgtcactttttttttttgtaaaataaaaacataccttacaaaaaaaaaa

SEQ ID NO: 335782 - DNA, 1989 bp, Homo sapiens
attgaacacaaccatgactcaggcactgggctaggtgcttgggatacatccgtgagccacacaaagttccccaccccagaggagctcttacctggcccagaatctggatctctgcccccagcccctatcctcaaggtagagtcccaaagatgtcctaaatctcacacaggctgagttgtgcttaatccatttctgcagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggcgtggcctcctactgccgtccctgtgccctagaagcctctgatgtgggctcctcctgcacctcttgtcctgctggttactatattgaccgagattcaggaacctgccactcctgcccccctaacacaattctgaaagcccaccagccttatggtgtccaggcctgtgtgccctgtggtccagggaccaagaacaacaagatccactctctgtgctacaatgattgcaccttctcacgcaacactccaaccaggactttcaactacaacttctccgctttggcaaacaccgtcactcttgctggagggccaagcttcacttccaaagggttgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcagatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaagtacatgttgcggtattggagtgtg

SEQ ID NO: 335783 - DNA, 450 bp, Homo sapiens
gaagggagcaagcagaatagagggtatctcatttctgtgtttccacaaagccactgaaacaggaatttcataagggttccttctgtcacctattttccatttctctcctttgtccccaaacttgcccctgtgcagcagccagctcctgtcaccatctctctttcagaggactcctgatggatttgactcagtgccgctgaagacatcctcaggaggcccagacatggacctgtgagaggcactgcctgcctcacctgcctcctcaccttgcatagcacctttgcaagcctgcggcgatttgggtgccagcatcctgcaacacccactgctggaaatctcttcattgtggccttatcagatgtttgaatttcagatctttttttatagagtacccaaaccctcctttctgcttgcctcaaacctgccaaatatacccacactttgtttgta

SEQ ID NO: 335784 - DNA, 4461 bp, Homo sapiens
  misc_feature (2893)..(2893): n is a, c, g, or t
  misc_feature (2907)..(2908): n is a, c, g, or t
  misc_feature (2949)..(2949): n is a, c, g, or t
  misc_feature (2990)..(2991): n is a, c, g, or t
  misc_feature (3176)..(3176): n is a, c, g, or t
  misc_feature (3215)..(3215): n is a, c, g, or t
  misc_feature (3233)..(3233): n is a, c, g, or t
  misc_feature (3248)..(3248): n is a, c, g, or t
  misc_feature (3256)..(3256): n is a, c, g, or t
  misc_feature (3286)..(3286): n is a, c, g, or t
  misc_feature (3288)..(3288): n is a, c, g, or t
  misc_feature (3303)..(3303): n is a, c, g, or t
  misc_feature (3314)..(3314): n is a, c, g, or t
  misc_feature (3366)..(3366): n is a, c, g, or t
attgaacacaaccatgactcaggcactgggctaggtgcttgggatacatccgtgagccacacaaagttccccaccccagaggagctcttacctggcccagaatctggatctctgcccccagcccctatcctcaaggtagagtcccaaagatgtcctaaatctcacacaggctgagttgtgcttaatccatttctgcagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggcgtggcctcctactgccgtccctgtgccctagaagcctctgatgtgggctcctcctgcacctcttgtcctgctggttactatattgaccgagattcaggaacctgccactcctgcccccctaacacaattctgaaagcccaccagccttatggtgtccaggcctgtgtgccctgtggtccagggaccaagaacaacaagatccactctctgtgctacaatgattgcaccttctcacgcaacactccaaccaggactttcaactacaacttctccgctttggcaaacaccgtcactcttgctggagggccaagcttcacttccaaagggttgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcagatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagaggactcctgatggatttgactcagtgccgctgaagacatcctcaggaggcccagacatggacctgtgagaggcactgcctgcctcacctgcctcctcaccttgcatagcacctttgcaagcctgcggcgatttgggtgccagcatcctgcaacacccactgctggaaatctcttcattgtggccttatcagatgtttgaatttcagatctttttttatagagtacccaaaccctcctttctgcttgcctcaaacctgccaaatatacccacactttgtttgtaaattaaaaaaaatgcccttgcttgtatcttgtttcccaaaatggcccatccgccagagccatagcttcgtctgctcataattcttatagctttggaatgaaaatatttctatcttcttaagtatagaaactatttcctctgtcctctaacttaagggcagaaacagctgggagttttcctcgcatgccctcagctcatgatctcttcaggagagaggctgggtgaggagggtgtcggggttccctggtggataatcttcatagcagcctggatccatttcccctggataaccagctcaaagggagtgaaaatggtagtctgagggcaaggggagcaaggcctgggtaagaaaagccttgaaaagcataaaaagaggccgggcgcggtggctcacgcctgtaatcccagcactttgggaggccgaggcgggcagatcatgaggtcgggagattgagaccatcctggctaacacggtgaanccccgtctctactnnaaatacaaaaaattagccgggcgtggtggcgggtgcctgtngtcccagctactcgggaggctgaggcgggagaatagcgtgnncctggaaggcggagcttgcagtgagccgagatcgcgccactgcactccatccagcctgggtgacagagtgagactctgcctcaaaaaaaaaaaaaaaaaagaaaagcacaaagagaggcaacaaggaatgtttttgtttttgagacaggctctcactctgtcacctaggctggagtgcagtggcntaatcactgttcagtgcagcctcaagctcttgggctcangctatcctcccatctcancctctcaagtagctnggactacnagtgtgcaccaccaggctcactaatttttntnttttttgtagacacngggtttcaccntgttgcccaggctggtctccaactcctgggctcaagtgatctgtccgcctcngcctcccaaactgctgggattacaggcataagccactgcactcagccttttatttgttttttaaaccacgtagctcattgccttctcttaagtaaatgatagatattctcactgaagccaaaggaataagttcatcaagaaaatgcccaaagccctggtggatacatcctccctatcttttttttaaaccttccactatcactctatgacactgaaaagaaccaggtaagccccaaacccagatgttccagccttatcctctattgggtttacccacagacatagcaaaccctgtcagtgaggaaaattccccatccttgagtgcccccgtcctagaagtttgggccatattatggaacaggggtctcttatttgaaaagagcacaaggaggccaagattttaatggggcactttaggggatacagcccacaatggcatgggcctgaggtggccgtgatgtctgcttctaagcttaacgcatctgctcaggcacagaataaacgtctaggctggccaaaaaaggaactgaatcccaggcccatacgccagcaccagaatcaaaccagtcttcaaggaaggaaggctaggagagtttaacaagattttcacgtgcctggcctacatgttcaattttctatgaacaaaggctttagtccttgacccagggctaaagtggtctgtccaagctgttgttggtagagggagtatgataaaatgtttaaatctcatttggttaccttgagtcctggaacacgcagtaactgtcatgctatagtcatcatctgtatttggctgggaatacaaatgaagattgtggtgtattcaagcagtagggtttttgcttttgtttttgttttagtgccaacaaaacttttttttgtctgactacattaaagataagactgactatatttatacaacagaaactttgtaatagattttttcagctttgtgaaatcgaattttttttcatcagggctggttggatttcctttttaccctgtaatccaagcgttaatagtttgttagaagatgggttattgcatgtcactttttttttttgtaaaataaaaacataccttacaaaaaaaaaa

SEQ ID NO: 335785 - DNA, 6065 bp, Homo sapiens
  misc_feature (2978)..(2978): n is a, c, g, or t
  misc_feature (2992)..(2993): n is a, c, g, or t
  misc_feature (3034)..(3034): n is a, c, g, or t
  misc_feature (3075)..(3076): n is a, c, g, or t
  misc_feature (3261)..(3261): n is a, c, g, or t
  misc_feature (3300)..(3300): n is a, c, g, or t
  misc_feature (3318)..(3318): n is a, c, g, or t
  misc_feature (3333)..(3333): n is a, c, g, or t
  misc_feature (3341)..(3341): n is a, c, g, or t
  misc_feature (3371)..(3371): n is a, c, g, or t
  misc_feature (3373)..(3373): n is a, c, g, or t
  misc_feature (3388)..(3388): n is a, c, g, or t
  misc_feature (3399)..(3399): n is a, c, g, or t
  misc_feature (3451)..(3451): n is a, c, g, or t
  misc_feature (5491)..(5491): n is a, c, g, or t
attgaacacaaccatgactcaggcactgggctaggtgcttgggatacatccgtgagccacacaaagttccccaccccagaggagctcttacctggcccagaatctggatctctgcccccagcccctatcctcaaggtagagtcccaaagatgtcctaaatctcacacaggctgagttgtgcttaatccatttctgcagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggcgtggcctcctactgccgtccctgtgccctagaagcctctgatgtgggctcctcctgcacctcttgtcctgctggttactatattgaccgagattcaggaacctgccactcctgcccccctaacacaattctgaaagcccaccagccttatggtgtccaggcctgtgtgccctgtggtccagggaccaagaacaacaagacgggggagaaaactgctactcttggctgcaggccctcaaggcccttcctgaccagctggcccgacccgtccctctccccctcagatccactctctgtgctacaatgattgcaccttctcacgcaacactccaaccaggactttcaactacaacttctccgctttggcaaacaccgtcactcttgctggagggccaagcttcacttccaaagggttgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcagatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagaggactcctgatggatttgactcagtgccgctgaagacatcctcaggaggcccagacatggacctgtgagaggcactgcctgcctcacctgcctcctcaccttgcatagcacctttgcaagcctgcggcgatttgggtgccagcatcctgcaacacccactgctggaaatctcttcattgtggccttatcagatgtttgaatttcagatctttttttatagagtacccaaaccctcctttctgcttgcctcaaacctgccaaatatacccacactttgtttgtaaattaaaaaaaatgcccttgcttgtatcttgtttcccaaaatggcccatccgccagagccatagcttcgtctgctcataattcttatagctttggaatgaaaatatttctatcttcttaagtatagaaactatttcctctgtcctctaacttaagggcagaaacagctgggagttttcctcgcatgccctcagctcatgatctcttcaggagagaggctgggtgaggagggtgtcggggttccctggtggataatcttcatagcagcctggatccatttcccctggataaccagctcaaagggagtgaaaatggtagtctgagggcaaggggagcaaggcctgggtaagaaaagccttgaaaagcataaaaagaggccgggcgcggtggctcacgcctgtaatcccagcactttgggaggccgaggcgggcagatcatgaggtcgggagattgagaccatcctggctaacacggtgaanccccgtctctactnnaaatacaaaaaattagccgggcgtggtggcgggtgcctgtngtcccagctactcgggaggctgaggcgggagaatagcgtgnncctggaaggcggagcttgcagtgagccgagatcgcgccactgcactccatccagcctgggtgacagagtgagactctgcctcaaaaaaaaaaaaaaaaaagaaaagcacaaagagaggcaacaaggaatgtttttgtttttgagacaggctctcactctgtcacctaggctggagtgcagtggcntaatcactgttcagtgcagcctcaagctcttgggctcangctatcctcccatctcancctctcaagtagctnggactacnagtgtgcaccaccaggctcactaatttttntnttttttgtagacacngggtttcaccntgttgcccaggctggtctccaactcctgggctcaagtgatctgtccgcctcngcctcccaaactgctgggattacaggcataagccactgcactcagccttttatttgttttttaaaccacgtagctcattgccttctcttaagtaaatgatagatattctcactgaagccaaaggaataagttcatcaagaaaatgcccaaagccctggtggatacatcctccctatcttttttttaaaccttccactatcactctatgacactgaaaagaaccaggtaagccccaaacccagatgttccagccttatcctctattgggtttacccacagacatagcaaaccctgtcagtgaggaaaattccccatccttgagtgcccccgtcctagaagtttgggccatattatggaacaggggtctcttatttgaaaagagcacaaggaggccaagattttaatggggcactttaggggatacagcccacaatggcatgggcctgaggtggccgtgatgtctgcttctaagcttaacgcatctgctcaggcacagaataaacgtctaggctggccaaaaaaggaactgaatcccaggcccatacgccagcaccagaatcaaaccagtcttcaaggaaggaaggctaggagagtttaacaagattttcactgggcccagcatggtggctcacacctgtaatcccaaggcagaatggtggcttgagctcaggagttcaagaccagcctgggcaacacagtgagaccctgtctctaaaaaatttaaaaataaacaaggtgttcaccaagctgggatacttctcactattaagcccctatctttctctttttttcattctcaattgctttgtgtgataaaaaactaaagagacttctggtccaatttctggcaacatcccttctgaaaggtgagtagagtgggtgtcttctatgcccattttccccaattttacacaaactattatcaatgaacttttaagtacctagaatgggtaaaaccagagcaagactttaaattaccttcttctttcttctactggcagttctgcctccatcactatcaggctagggtgaccttcccttggtcaagccccaattgcccatgatttgtgcctgtgccctttctccagtgaccatttggtgaccagatggtagatatagaaaggggatggcatttgcaagtgactagtctgccacaaaatgctcatctgattagccactgctgccctggcaatggctttgtaagagtcaatgagaactagagccaggctgtggtccctggccatcaacagtgttggtgacggcagggagtccctttggtttaataaatccagtttttctttgggtatccaaattctcccctccttttgtaggagtcaggctctcagaacctgtgtccatgttggaacttcccccagtgtggatgcagatacgcagctcctgagctccagcctaaagtcttctgtagcctcagcaatacttgggcacctgctgtctcactgaatagctttcttttgtgacaaaggccacagacagcccttagactattccggaaacagtaggaaaaattacatatgtctttgacttctttattctgactccactgattttagccataatactttaaggagctactttttactaccccttaccgtgctgacttctgcaggtctgccctgtgacctgtcaggaactcctgagttacgctactggggtcacctgttgctcccctagcaagttaggcatgtcatatatttttaacagctttattgagatataattcacatattatacaattcacctttaaaacatacgattcaatggttttcagcaaactcacagagttgtccgcccacttgagagcaaacacatgttcaattttcttttcctttttttttttgagacagagtcagctttgttgcccaggctggagtgcagtgccatgatcttggctcactgcagcctccccatcctgggttcaagtgatccttctgcttcagcctccccagtagctgggattacaggcatgcgccaccacgcctagctaatttttgtgtttttagtagagatggggtttcaccntgttggccaggctggtctcaaactcctggactcaagtgatccacccacctcggcctcccaaagtgctgggattacaggtgtaagccaccgtgcctggcctacatgttcaattttctatgaacaaaggctttagtccttgacccagggctaaagtggtctgtccaagctgttgttggtagagggagtatgataaaatgtttaaatctcatttggttaccttgagtcctggaacacgcagtaactgtcatgctatagtcatcatctgtatttggctgggaatacaaatgaagattgtggtgtattcaagcagtagggtttttgcttttgtttttgttttagtgccaacaaaacttttttttgtctgactacattaaagataagactgactatatttatacaacagaaactttgtaatagattttttcagctttgtgaaatcgaattttttttcatcagggctggttggatttcctttttaccctgtaatccaagcgttaatagtttgttagaagatgggttattgcatgtcactttttttttttgtaaaataaaaacataccttacaaaaaaaaaa

SEQ ID NO: 335786 - DNA, 1200 bp, Homo sapiens
attgaacacaaccatgactcaggcactgggctaggtgcttgggatacatccgtgagccacacaaagttccccaccccagaggagctcttacctggcccagaatctggatctctgcccccagcccctatcctcaaggtagagtcccaaagatgtcctaaatctcacacaggctgagttgtgcttaatccatttctgcagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggcgtggcctcctactgccgtccctgtgccctagaagcctctgatgtgggctcctcctgcacctcttgtcctgctggttactatattgaccgagattcaggaacctgccactcctgcccccctaacacaattctgaaagcccaccagccttatggtgtccaggcctgtgtgccctgtggtccagggaccaagaacaacaagatcacttttgggctcaggattgacttttaagcaaactcaaccaggatttactacactttccgtttggaataacgttcgttttcgccgaccggaccg

SEQ ID NO: 335787 - DNA, 529 bp, Homo sapiens
tagtattggcattaacactgacctttatttaaggttctaatttgttcatgttgggcacttagaacatcggtttgttgttttttttttgtgagattctggaaacattccaattttaccttttccccttgactccagactttttaacactggtctgctactgttaagttgtatgccattttgttaggccttctcaagtgggaatcaggaacgctgctgtgctctagagatgttttgttcttcctgtagggctgaagcagtgcctactcgatagaatcagtcatcatgcaaataaaagccacctgagtcaaaggcaaagccagagtgcagcttggagcaaagaagttaaaagcatattggcagaggaagagccctggcattccagcaggagctttatatttgtaactgcctacccgcattaagaaaattaaaattttttaaattccgttgactccataattttttcccccttgagggggggggcccgggtccccaaaaatagggccctattatggggagttctatattttag

SEQ ID NO: 335788 - DNA, 578 bp, Homo sapiens
tagtattggcattaacactgacctttatttaaggttctaatttgttcatgttgggcacttagaacatcggtttgttgttttttttttgtgagattctggaaacattccaattttaccttttccccttgactccagactttttaacactggtctgctactgttaagttgtatgccattttgttaggccttctcaagtgggaatcaggaacgctgctgtgctctagagatgttttgttcttcctgtagggctgaagcagtgcctactcgatagaatcagtcatcatgcaaataaaagccacctgagtcaaaggcaaagccagagtgcagcttggagcaaagaagttaaaagcatattggcagaggaagagccctggcattccagcaggagctaacaggaaaaagaaaatcaatggcagtagccctgacacagccacttctggtggttaccactcacctggggattcagcaacaggtatctacggggagggccgtgcatcctctactaccctggaggatctggagagccagtaccaagaactatcagtggccctggattcaagctccgcaataatcagtca

SEQ ID NO: 335789 - DNA, 180 bp, Homo sapiens
gtaaaccagtaaaataacattgtgcttggtgctgaacctatgctagtattggcattaacactgacctttatttaaggttctaatttgttcatgttgggcacttagaacatcggtttgttgttttttttttgtgagattctggaaacattccaattttaccttttccccttgactccagac

SEQ ID NO: 335790 - DNA, 194 bp, Homo sapiens
aacagattgtaaggacagaaataaataaataaaaagaatttctaaatgattttgttaaatgcaataacaactttatgtaaactacagatgaactgataatagagcacatgtaagaaaatgtctaaaaaatgttattggaaataaaattagagctgtaaatcattaacaaggaaaaaacattaacttatatacaa

SEQ ID NO: 335791 - DNA, 766 bp, Homo sapiens
acagatgggacaccaaacatttgatagaagattattaatatgagtggtagtaggacagaaagactgtcacatatttttgagggattttagaaaatataattttaaagggggcagcagttcaatactactttaaaaataatactccctggccgggtgtggtggctcatgactgtaatcccagcactttgggaggccgagacgagcggatcatgaggtcaggaaatcaagaccatcctggctaacacgacaaattatacctatttttctcaataacacatggctacagtgaaagacttccatttattgatcactttttggcctttggctgagatcaagagcactacctgaagatgaaagatgaaaggagctgatttgcagattctctccctatacatttttgttgtattgaatttcagtttcattttattctcttatctttcatggaatgttacaattacctaaattatacactaatatagaagcttttgagcaaaagggtgtatgtgctgtgaaggtcaacattttaaacgatcctaaaacataattgttttagaacgggcacttgtctgggtcccactgaatgactcatttcacggcatcacattcaaaatggattctatcaaaggaaaaccaactcattctcaagatgaaattcatcctttgcatattatgtatcaatgatatcactcttccagtgccagttgtggaaaaataggtttcaacatagagtggcttgtactgtgtatttaataaagctttcagaatg

SEQ ID NO: 335792 - DNA, 752 bp, Homo sapiens
ctttgctgcaacgactctcttaatttccaccgctacacggattttagaaaatataattttaaagacaaattatacctatttttctcaataacacatggctacagtgaaagacttccatttattgacggagtcttgccctgtcactcaggctggagtgcagtggcacaatctctgctcactgccagcctctgcctcccgggttccagtggttcttctgcctcagcctcctggacagctgggattaaaggtacccgccaccaaacctcagcctcctggacagctgggattacagatcactttttggcctttggctgagatcaagagcactacctgaagatgaaagatgaaaggagctgatttgcagattctctccctatacatttttgttgtattgaatttcagtttcattttattctcttatctttcatggaatgttacaattacctaaattatacactaatatagaagcttttgagcaaaagggtgtatgtgctgtgaaggtcaacattttaaacgatcctaaaacataattgttttagaacgggcacttgtctgggtcccactgaatgactcatttcacggcatcacattcaaaatggattctatcaaaggaaaaccaactcattctcaagatgaaattcatcctttgcatattatgtatcaatgatatcactcttccagtgccagttgtggaaaaataggtttcaacatagagtggcttgtactgtgtatttaataaagctttcagaatg

SEQ ID NO: 335793 - DNA, 175 bp, Homo sapiens
cctgatcccttctatctcaggccataaccagcggctgaccaatcgcttctttgatgctttagtgacttactcttttccagctgtttggtgatttagaatgaatggagctctggggtttccatgcattactatatttgaaaatcttggctgctccttctcaagtcctttagacttg

SEQ ID NO: 335794 - DNA, 178 bp, Homo sapiens
cctcctgagtagctgggattacagccatgcaccatcacacccagctaatttttgtatttttagtagagacaggtttttgccatgttagccaggctggtcttgaactcctggcctcaagtgatccaccacacccaacctatctcaaacttttaaagcatacaaccaaaataggaaattt

SEQ ID NO: 335795 - DNA, 156 bp, Homo sapiens
tcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagc

SEQ ID NO: 335796 - DNA, 102 bp, Homo sapiens
gaacatgaagaaaataggtgagagtcacattgtaaaacttggggtaatattttaggaagtttatcagctagtctggaaactacacggaaggaaagaaaaaaa

SEQ ID NO: 335797 - DNA, 398 bp, Homo sapiens
tttgtgcccaaagcaattgagaaaatgaaggggccattagcaggtatgcaatatattgtgggaagacttggggaagaaagggatggatatcaggagctccttttggacttgttcactttgggataccagttaagacatctgaatacagatatcaaggaggcagctgaacatgcagatgtgaggctgacggggaagaggtcaggccaaaaaatgtaaactaggagttagcatacggatggaatttaaaaccataacattgaatgagataattttggaaatctctgtagacagaaaagaacccaagatcagagcgctgaggtgctccagtattaaagaatcaatatttataaaatgaatgaattaatgaatcctgattttttgttttcaactttcagaat

SEQ ID NO: 335798 - DNA, 248 bp, Homo sapiens
ttgcggtgatgaggatagtttttaatcaggttcctgatgttttctcttaaggttgtgcacatagaaaccacttctgttagaaataacgaatgataacagctaccaggagcatgagtacaaagaagtgtgaagctttagtctaaattacaactaggttacaattatttatgtactgttcagagatgataaaaatagtctccccttctaaacctagaaacatcatattgtacaaaacatttattatttaa

SEQ ID NO: 335799 - DNA, 2474 bp, Homo sapiens
ccgcagaggagcctcggccaggcttgccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccagtgcaaggcatcacgggttgttagcatcggcacgtcagcctggggtctgtcactatggaactaaactggcctgctgctacggctggagaagaaacagcaagggagtctgtgaagctacatgcgaacctggatgtaagtttggtgagtgcgtgggaccaaacaaatgcagatgctttccaggatacaccgggaaaacctgcagtcaagatgtgaatgagtgtggaatgaaaccccggccatgccaacacagatgtgtgaatacacacggaagctacaagtgcttttgcctcagtggccacatgctcatgccagatgctacgtgtgtgaactctaggacatgtgccatgataaactgtcagtacagctgtgaagacacagaagaagggccacagtgcctgtgtccatcctcaggactccgcctggccccaaatggaagagactgtctagatattgatgaatgtgcctctggtaaagtcatctgtccctacaatcgaagatgtgtgaacacatttggaagctactactgcaaatgtcacattggtttcgaactgcaatatatcagtggacgatatgactgtatagatataaatgaatgtactatggatagccatacgtgcagccaccatgccaattgcttcaatacccaagggtccttcaagtgtaaatgcaagcagggatataaaggcaatggacttcggtgttctgctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaaatgaaagaggggcttgaggatgagaaaagagaagagaaagccctgaagaatgacatagaggagcgaagcctgcgaggagatgtgtttttccctaaggtgaatgaagcaggtgaattcggcctgattctggtccaaaggaaagcgctaacttccaaactggaacataaagatttaaatatctcggttgactgcagcttcaatcatgggatctgtgactggaaacaggatagagaagatgattttgactggaatcctgctgatcgagataatgctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgagtgtttgtgaaaaacagtaacaatgccctggcatgggagaagaccacgagtgaggatgaaaagtggaagacagggaaaattcagttgtatcaaggaactgatgctaccaaaagcatcatttttgaagcagaacgtggcaagggcaaaaccggcgaaatcgcagtggatggcgtcttgcttgtttcaggcttatgtccagatagccttttatctgtggatgactgaatgttactatctttatatttgactttgtatgtcagttccctggtttttttgatattgcatcataggacctctggcattttagaattactagctgaaaaattgtaatgtaccaacagaaatattattgtaagatgcctttcttgtataagatatgccaatatttgctttaaatatcatatcactgtatcttctcagtcatttctgaatctttccacattatattataaaatatggaaatgtcagtttatctcccctcctcagtatatctgatttgtataagtaagttgatgagcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaaattctttgtaataataatatccaaatcatcatcttgtgtcatggtttaatttttctaggtaagaaaatatgttcttgattctgtgtttacttatgtaaatgattatttgcttttctgaaaaat

SEQ ID NO: 335800 - DNA, 747 bp, Homo sapiens
  misc_feature (322)..(322): n is a, c, g, or t
  misc_feature (327)..(329): n is a, c, g, or t
  misc_feature (333)..(333): n is a, c, g, or t
  misc_feature (342)..(342): n is a, c, g, or t
  misc_feature (351)..(351): n is a, c, g, or t
  misc_feature (357)..(357): n is a, c, g, or t
  misc_feature (359)..(359): n is a, c, g, or t
  misc_feature (361)..(364): n is a, c, g, or t
  misc_feature (368)..(369): n is a, c, g, or t
  misc_feature (375)..(375): n is a, c, g, or t
  misc_feature (393)..(393): n is a, c, g, or t
  misc_feature (404)..(404): n is a, c, g, or t
  misc_feature (418)..(418): n is a, c, g, or t
  misc_feature (425)..(425): n is a, c, g, or t
  misc_feature (447)..(448): n is a, c, g, or t
  misc_feature (452)..(452): n is a, c, g, or t
  misc_feature (460)..(460): n is a, c, g, or t
  misc_feature (473)..(473): n is a, c, g, or t
  misc_feature (496)..(497): n is a, c, g, or t
  misc_feature (514)..(514): n is a, c, g, or t
  misc_feature (516)..(516): n is a, c, g, or t
  misc_feature (530)..(530): n is a, c, g, or t
  misc_feature (533)..(534): n is a, c, g, or t
  misc_feature (538)..(538): n is a, c, g, or t
  misc_feature (550)..(550): n is a, c, g, or t
  misc_feature (552)..(554): n is a, c, g, or t
  misc_feature (556)..(556): n is a, c, g, or t
  misc_feature (559)..(561): n is a, c, g, or t
  misc_feature (564)..(567): n is a, c, g, or t
  misc_feature (569)..(571): n is a, c, g, or t
  misc_feature (586)..(586): n is a, c, g, or t
  misc_feature (590)..(591): n is a, c, g, or t
  misc_feature (593)..(595): n is a, c, g, or t
  misc_feature (598)..(598): n is a, c, g, or t
  misc_feature (600)..(602): n is a, c, g, or t
  misc_feature (605)..(606): n is a, c, g, or t
  misc_feature (608)..(608): n is a, c, g, or t
  misc_feature (611)..(612): n is a, c, g, or t
  misc_feature (614)..(614): n is a, c, g, or t
  misc_feature (617)..(618): n is a, c, g, or t
  misc_feature (621)..(621): n is a, c, g, or t
  misc_feature (629)..(629): n is a, c, g, or t
  misc_feature (643)..(643): n is a, c, g, or t
  misc_feature (650)..(650): n is a, c, g, or t
  misc_feature (655)..(655): n is a, c, g, or t
  misc_feature (669)..(669): n is a, c, g, or t
  misc_feature (677)..(677): n is a, c, g, or t
  misc_feature (737)..(737): n is a, c, g, or t
ccgcagaggagcctcggccaggcttgccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccagtccaaccnataannncttnttacaatcnccacgtcancttggncncnnnnaatnngcaacnaaattcccttctttcttnccctgctttanaaaaactcaagtcntactctngtgaactgacatccccacaccnnccanctaacatntcgctcactctcnccccactaaacaaagctcacagnngggtccacctagacacncnccaataaccgtcanttnnccancttcaagctctntnnntnttnnnatnnnncnnnatttttttttttttntttnntnnntanannnttnntnttnntnctnnggnccgcacgncccacaggcgcagnccacagncgacngcgcgcaacgcgancacagcgnccagcagaaacgcgcacgacaccgcgcaacacacacaacaacccccacacgcccgcgcgncagccgcacc

SEQ ID NO: 335801 - DNA, 2677 bp, Homo sapiens
ccgcagaggagcctcggccaggcttgccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccagtgcaaggcatcacgggttgttagcatcggcacgtcagcctggggtctgtcactatggaactaaactggcctgctgctacggctggagaagaaacagcaagggagtctgtgaagctacatgcgaacctggatgtaagtttggtgagtgcgtgggaccaaacaaatgcagatgctttccaggatacaccgggaaaacctgcagtcaagatgtgaatgagtgtggaatgaaaccccggccatgccaacacagatgtgtgaatacacacggaagctacaagtgcttttgcctcagtggccacatgctcatgccagatgctacgtgtgtgaactctaggacatgtgccatgataaactgtcagtacagctgtgaagacacagaagaagggccacagtgcctgtgtccatcctcaggactccgcctggccccaaatggaagagactgtctagatattgatgaatgtgcctctggtaaagtcatctgtccctacaatcgaagatgtgtgaacacatttggaagctactactgcaaatgtcacattggtttcgaactgcaatatatcagtggacgatatgactgtatagatataaatgaatgtactatggatagccatacgtgcagccaccatgccaattgcttcaatacccaagggtccttcaagtgtaaatgcaagcagggatataaaggcaatggacttcggtgttctgctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaaatgaaagaggggcttgaggatgagaaaagagaagagaaagccctgaagaatgacatagaggagcgaagcctgcgaggagatgtgtttttccctaaggtgaatgaagcaggtgaattcggcctgattctggtccaaaggaaagcgctaacttccaaactggaacataaagatttaaatatctcggttgactgcagcttcaatcatgggatctgtgactggaaacaggatagagaagatgattttgactggaatcctgctgatcgagataatgagctatatcatattgggagcccataggttattccaggacctccacagctgatataaggttatgttaagtcttaagttgagtcttctgtccaagggaagttccctatttacaaacactcaattcacaaataaccccagggttctcagcttctgcatcattcaaatcatacccctgctcctcctgcacctccattggatttctagctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgagtgtttgtgaaaaacagtaacaatgccctggcatgggagaagaccacgagtgaggatgaaaagtggaagacagggaaaattcagttgtatcaaggaactgatgctaccaaaagcatcatttttgaagcagaacgtggcaagggcaaaaccggcgaaatcgcagtggatggcgtcttgcttgtttcaggcttatgtccagatagccttttatctgtggatgactgaatgttactatctttatatttgactttgtatgtcagttccctggtttttttgatattgcatcataggacctctggcattttagaattactagctgaaaaattgtaatgtaccaacagaaatattattgtaagatgcctttcttgtataagatatgccaatatttgctttaaatatcatatcactgtatcttctcagtcatttctgaatctttccacattatattataaaatatggaaatgtcagtttatctcccctcctcagtatatctgatttgtataagtaagttgatgagcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaaattctttgtaataataatatccaaatcatcatcttgtgtcatggtttaatttttctaggtaagaaaatatgttcttgattctgtgtttacttatgtaaatgattatttgcttttctgaaaaat

SEQ ID NO: 335802 - DNA, 2610 bp, Homo sapiens
ccgcagaggagcctcggccaggcttgccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccagtgcaaggcatcacgggttgttagcatcggcacgtcagcctggggtctgtcactatggaactaaactggcctgctgctacggctggagaagaaacagcaagggagtctgtgaagctacatgcgaacctggatgtaagtttggtgagtgcgtgggaccaaacaaatgcagatgctttccaggatacaccgggaaaacctgcagtcaagatgtgaatgagtgtggaatgaaaccccggccatgccaacacagatgtgtgaatacacacggaagctacaagtgcttttgcctcagtggccacatgctcatgccagatgctacgtgtgtgaactctaggacatgtgccatgataaactgtcagtacagctgtgaagacacagaagaagggccacagtgcctgtgtccatcctcaggactccgcctggccccaaatggaagagactgtctagatattgatgaatgtgcctctggtaaagtcatctgtccctacaatcgaagatgtgtgaacacatttggaagctactactgcaaatgtcacattggtttcgaactgcaatatatcagtggacgatatgactgtatagatataaatgaatgtactatggatagccatacgtgcagccaccatgccaattgcttcaatacccaagggtccttcaagtgtaaatgcaagcagggatataaaggcaatggacttcggtgttctgctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaaatgaaagaggggcttgaggatgagaaaagagaagagaaagccctgaagaatgacatagaggagcgaagcctgcgaggagatgtgtttttccctaaggtgaatgaagcaggtgaattcggcctgattctggtccaaaggaaagcgctaacttccaaactggaacataaagatttaaatatctcggttgactgcagcttcaatcatgggatctgtgactggaaacaggatagagaagatgattttgactggaatcctgctgatcgagataatgctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgagtgtttgtgaaaaacagtaacaatgccctggcatgggagaagaccacgagtgaggatgaaaagtggaagacagggaaaattcagttgtatcaaggaactgatgctaccaaaagcacatgcccccaaagagcctggccagcaatcacactggaacacagcagtgctttcataagaggcattctcagacccaggcatctgttccttgaattcttcagttctaggggaaatcttgatggggggatattgaaggatcatttttgaagcagaacgtggcaagggcaaaaccggcgaaatcgcagtggatggcgtcttgcttgtttcaggcttatgtccagatagccttttatctgtggatgactgaatgttactatctttatatttgactttgtatgtcagttccctggtttttttgatattgcatcataggacctctggcattttagaattactagctgaaaaattgtaatgtaccaacagaaatattattgtaagatgcctttcttgtataagatatgccaatatttgctttaaatatcatatcactgtatcttctcagtcatttctgaatctttccacattatattataaaatatggaaatgtcagtttatctcccctcctcagtatatctgatttgtataagtaagttgatgagcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaaattctttgtaataataatatccaaatcatcatcttgtgtcatggtttaatttttctaggtaagaaaatatgttcttgattctgtgtttacttatgtaaatgattatttgcttttctgaaaaat

SEQ ID NO: 335803 - DNA, 231 bp, Homo sapiens
aatacaggagcttctccaggatcagttctaatacctcatatattctcactttttactactttatccactctttactgcttagacccttcaaatcaatatatccaagtgcctaccagatatacagacttagatacttcaaaggcatcaaactcattctattcaagatcaatttttctcttctgccagcattttctctctctttactagacacctctgtggaaataaacagag

SEQ ID NO: 335804 - DNA, 325 bp, Homo sapiens
tgtcagggagagaagtttgtttgaaatgcagtttcaagggactccaacccagagagtctgtttcactcagtctatggtaggatacaaaagtatactttttaaaaggagcatcccaggtggttctgacataggggtgatctgtttaccaccatcctgagaaagaaagactgccacaggccagtgctttcccgtttttaatgtctatacagatcttctgaaggtcttgtttaaatgcagattcttagtttgtagacctgggtgggacctaagattctgcattttggttgctttttcagattgcatgtgggaattatatgtgatttgg

SEQ ID NO: 335805 - DNA, 455 bp, Homo sapiens
ctgggattacaggtgtgagccactgcacccagccttattatgcagactttcaataaaagttcttagttctgagtcttatctcaattccctgccatgcctggggtacctaaatctggagcttcttaggttcaatttttccagacttcaaatttaactacacaggtgagggttctagggaaccaagtgatagacagtgatctgttctctttttaccagatagatcaccctattttatcccttaatgacaaaaggactttctataatgtctcaaacatagggttgccagatttaataagtaaaaatacaaaatgtctggttaaatttgaatttcagattttcagatgaacaatgcaatatgtcggatatacttatactaaaagtaatttgtttctttgaaattcatatttgaccaatagcctttatttatttatttatttatttatttattttgagat

SEQ ID NO: 335806 - DNA, 351 bp, Homo sapiens
ggaatattggagtttcataatggctttggattaaggcctcgtcactattgactgacttggttgaaaactgctggcttcttaaaggtcaagcattattattcaccaacttttatagtcatttgtaatatgggatgatatgcagaatcaggatctccctggattctcttctgaatacctaaggagtcagagtttatcaagagcaggcgggtacagtatattattgattccttcttatgaacttgcagagtttttgtagaagatcagctgcaccctagctgaaatacacatggattctgaaaataaacatacatatgggaaaacataatccactgcggatgaaagatttatcag

SEQ ID NO: 335807 - DNA, 448 bp, Homo sapiens
agagtgagtgaactaggacgatgttcagaagcccccaagttagtgggcaacatatcttcctgctcctactgtgtaggagacaatcatttctgctgcaagtcccgtccagtagtctctcagtatctcaggacccctacctctgctttacccaactatgagccatacccagcctccattccttcacccacactgcccttggcacactagacatcaaagtttccacactttatcacacccttttaaattctgagagacagtgtctcactctgctatctaggctagactgtatttggtgttctaccttcaatgtagccctcaccccccttttaaaaatactaaacttataggaaaataaaatattttaagggctgtggtgtgaacacagctcactggagcctcaaactcctgggcccactggctcaggcaatccctcttgcctcagcctccc

SEQ ID NO: 335808 - DNA, 695 bp, Homo sapiens
tcagcgggaatgcacatgtgctgtctgtgtctgggtgggtttgtgttcaggttcttgggtggggtaactcctcttgcagcacagagagtgtccctcttctcgcctctccctcccggttcccctcctgtggttctagtccaggtccccacacttctgtttacataaaggcatttggctttgacctagtcatggctctccagtcgcccacctgacccctgccaaggccctggggttttaaactgagctcacatagggccttgtggaagaagtactgggtgctggagggagagctcggggcccagcccatgccccacacgggcaagcagcccactgatctgttttgtagctgaggttttgcatacggttttgtttggaggatggcttctgctgctaaaaatacaaaagtttggaaaccgctgctcttggaggatgaggtttcttggcatttctcaagattgggagctgtttgaaaggttgcccatcctcttccctcatgccttggggagtgagggacctctgctgtccttattggctgagtgagggtgttgattggccgtggaggggtccctttcagccctgatcatctaaggtgggggaggtggcttcatgatgaggggagaagtcagcaccagagtgacccccagtacccccactgactaaactgtgatcctaccctcaccaggcctcagttgccc

SEQ ID NO: 335809 - DNA, 1840 bp, Homo sapiens
ccaggggcactttgtgtgtgtgtgtgtgtgtgtgtgtgtgtgtgtgtacgcgcgtgtgcgtgtgacggggtactcgcgtggcccgaagatccgagggtcacactacgtgacttctgggtgtctgtgggtactgctgtgggaacagctgctgggggagtgtgtgtggaactggagtgttcctttcaggacctgtctgactgcagatgaaattagtaactggtggggtcgtggggtgtgaatggtgggcgggagcagctatgtcagttggtgtgtttctgcttatgttagggtaattgggcacggcctttgtgtaactggtgaatatctctgaacctgggcatgaaacagagagatgtcctaactctggtaaaagcagtctgggcgcaggctggggacccagatggaattcaaacttatgcctgctctcaaggtgctcacggttgctgataaacagctggataaaatgaagagtctatgagtgagggatgcagagccagggaaggctggtggagtgatgccaccagcacaggggtatgagtttgcagctgccaaggggccaagggatgagctggggccctccttcccaatggcatctccccctggtctggaactgaagacactgagcaatggtccccaagccccaaggagatcagctcccctgggcccagtggccccaaccagggagggtgtggagaatgcctgcttctcctcagaggagcatgagacccatttccagaaccctgggaacacgagactgggcagctcacccagtccccctgggggtgtctcctcactgccccgatcccagcgggatgatctgtcccttcattcagaggaggggccagccctggagcccgtgagccgcccggtggattatggctttgtttccgccctcgttttcctggtgagtgggattcttctggtggtgacagcatacgccatcccccgtgaggctcgagtcaatccggacacagtgacagcgcgggagatggaacgactggagatgtactacgcccgcctaggctcccacctggacaggtgcatcatcgcaggcctcgggctgctcacggtgggcggcatgctcttgtcggtgctgctcatggtctccctgtgcaagggcgagctgtaccgccggaggaccttcgtccccggcaagggctccaggaagacctacggctccattaacctgcgcatgagacagctcaatggggatgggggccaggccctggtggagaatgaagttgtccaggtctcagagactagccacaccctccagaggtcttaagaactagcccaccttatctggctgctttagctccagtgctacaaggtccaccccctgctcccgcccacctgacccctgccaaggccctggggttttaaactgagctcacatagggccttgtggaagaagtactgggtgctggagggagagctcggggcccagcccatgccccacacgggcaagcagcccactgatctgttttgtagctgaggttttgcatacggttttgtttggaggatggcttctgctgctaaaaatacaaaagtttggaaaccgctgctcttggaggatgaggtttcttggcatttctcaagattgggagctgtttgaaaggttgcccatcctcttccctcatgccttggggagtgagggacctctgctgtccttattggctgagtgagggtgttgattggccgtggaggggtccctttcagccctgatcatctaaggtgggggaggtggcttcatgatgaggggagaagtcagcaccagagtgacccccagtacccccactgactaaactgtgatcctaccctcaccaggcctcagttgccc

SEQ ID NO: 335810 - DNA, 1168 bp, Homo sapiens
ccaggggcactttgtgtgtgtgtgtgtgtgtgtgtgtgtgtgtgtgtacgcgcgtgtgcgtgtgacggggtactcgcgtggcccgaagatccgagggtcacactacgtgacttctgggtgtctgtgggtactgctgtgggaacagctgctgggggagtgtgtgtggaactggagtgttcctttcaggacctgtctgactgcagatgaaattagtaactggtggggtcgtggggtgtgaatggtgggcgggagcagctatgtcagttggtgtgtttctgcttatgttagggtaattgggcacggcctttgtgtaactggtgaatatctctgaacctgggcatgaaacagagagatgtcctaactctgggtgagaggaatcctcatttttctctgccctctcactgtggcatcctaagaaaaaagttttgggttcctgcagcatgaaggagagctctgctcccagaatttgggagctccagatttcttccagggtgtggaggcatcaatatatcagtctgggaaaggggttcctgggccactccaggagctgagttgggtggaaggtgctgagagtgtgggtgggggccacttctgagcacccatgtggcacccactgctggtccctgtttgtggctgggcactcaggaaaatgtttttggtgctaagagtaaaaacgcccacctgacccctgccaaggccctggggttttaaactgagctcacatagggccttgtggaagaagtactgggtgctggagggagagctcggggcccagcccatgccccacacgggcaagcagcccactgatctgttttgtagctgaggttttgcatacggttttgtttggaggatggcttctgctgctaaaaatacaaaagtttggaaaccgctgctcttggaggatgaggtttcttggcatttctcaagattgggagctgtttgaaaggttgcccatcctcttccctcatgccttggggagtgagggacctctgctgtccttattggctgagtgagggtgttgattggccgtggaggggtccctttcagccctgatcatctaaggtgggggaggtggcttcatgatgaggggagaagtcagcaccagagtgacccccagtacccccactgactaaactgtgatcctaccctcaccaggcctcagttgccc

SEQ ID NO: 335811 - DNA, 2193 bp, Homo sapiens
ccaggggcactttgtgtgtgtgtgtgtgtgtgtgtgtgtgtgtgtgtacgcgcgtgtgcgtgtgacggggtactcgcgtggcccgaagatccgagggtcacactacgtgacttctgggtgtctgtgggtactgctgtgggaacagctgctgggggagtgtgtgtggaactggagtgttcctttcaggacctgtctgactgcagatgaaattagtaactggtggggtcgtggggtgtgaatggtgggcgggagcagctatgtcagttggtgtgtttctgcttatgttagggtaattgggcacggcctttgtgtaactggtgaatatctctgaacctgggcatgaaacagagagatgtcctaactctgggtgagaggaatcctcatttttctctgccctctcactgtggcatcctaagaaaaaagttttgggttcctgcagcatgaaggagagctctgctcccagaatttgggagctccagatttcttccagggtgtggaggcatcaatatatcagtctgggaaaggggttcctgggccactccaggagctgagttgggtggaaggtgctgagagtgtgggtgggggccacttctgagcacccatgtggcacccactgctggtccctgtttgtggctgggcactcaggaaaatgtttttggtgctaagagtaaaaagccaaccaacaaacacatctcttttttctgtctattcactggaaagtaaaagcagtctgggcgcaggctggggacccagatggaattcaaacttatgcctgctctcaaggtgctcacggttgctgataaacagctggataaaatgaagagtctatgagtgagggatgcagagccagggaaggctggtggagtgatgccaccagcacaggggtatgagtttgcagctgccaaggggccaagggatgagctggggccctccttcccaatggcatctccccctggtctggaactgaagacactgagcaatggtccccaagccccaaggagatcagctcccctgggcccagtggccccaaccagggagggtgtggagaatgcctgcttctcctcagaggagcatgagacccatttccagaaccctgggaacacgagactgggcagctcacccagtccccctgggggtgtctcctcactgccccgatcccagcgggatgatctgtcccttcattcagaggaggggccagccctggagcccgtgagccgcccggtggattatggctttgtttccgccctcgttttcctggtgagtgggattcttctggtggtgacagcatacgccatcccccgtgaggctcgagtcaatccggacacagtgacagcgcgggagatggaacgactggagatgtactacgcccgcctaggctcccacctggacaggtgcatcatcgcaggcctcgggctgctcacggtgggcggcatgctcttgtcggtgctgctcatggtctccctgtgcaagggcgagctgtaccgccggaggaccttcgtccccggcaagggctccaggaagacctacggctccattaacctgcgcatgagacagctcaatggggatgggggccaggccctggtggagaatgaagttgtccaggtctcagagactagccacaccctccagaggtcttaagaactagcccaccttatctggctgctttagctccagtgctacaaggtccaccccctgctcccgcccacctgacccctgccaaggccctggggttttaaactgagctcacatagggccttgtggaagaagtactgggtgctggagggagagctcggggcccagcccatgccccacacgggcaagcagcccactgatctgttttgtagctgaggttttgcatacggttttgtttggaggatggcttctgctgctaaaaatacaaaagtttggaaaccgctgctcttggaggatgaggtttcttggcatttctcaagattgggagctgtttgaaaggttgcccatcctcttccctcatgccttggggagtgagggacctctgctgtccttattggctgagtgagggtgttgattggccgtggaggggtccctttcagccctgatcatctaaggtgggggaggtggcttcatgatgaggggagaagtcagcaccagagtgacccccagtacccccactgactaaactgtgatcctaccctcaccaggcctcagttgccc

SEQ ID NO: 335812 - DNA, 1591 bp, Homo sapiens
gcggccgccaccgccgccgtacagctccgcgcggcgcgagtaggtacgtgcgcctcggcagtggctccgggccgggccgggaagggggcgggagaccgggagggcgaggcggtggcggccgggcccgcgccctccgggctgcgccgcaggagagagacccccgcaggcgagacccccgcaggcgtacgccggctgcaggaaggcggacgggcaccggagaggacgcaccctcgcccgccggcggccgggcgcccttcgccccagcgtggtgaggcggggagggaggcccggcacagctgccaaggggccaagggatgagctggggccctccttcccaatggcatctccccctggtctggaactgaagacactgagcaatggtccccaagccccaaggagatcagctcccctgggcccagtggccccaaccagggagggtgtggagaatgcctgcttctcctcagaggagcatgagacccatttccagaaccctgggaacacgagactgggcagctcacccagtccccctgggggtgtctcctcactgccccgatcccagcgggatgatctgtcccttcattcagaggaggggccagccctggagcccgtgagccgcccggtggattatggctttgtttccgccctcgttttcctggtgagtgggattcttctggtggtgacagcatacgccatcccccgtgaggctcgagtcaatccggacacagtgacagcgcgggagatggaacgactggagatgtactacgcccgcctaggctcccacctggacaggtgcatcatcgcaggcctcgggctgctcacggtgggcggcatgctcttgtcggtgctgctcatggtctccctgtgcaagggcgagctgtaccgccggaggaccttcgtccccggcaagggctccaggaagacctacggctccattaacctgcgcatgagacagctcaatggggatgggggccaggccctggtggagaatgaagttgtccaggtctcagagactagccacaccctccagaggtcttaagaactagcccaccttatctggctgctttagctccagtgctacaaggtccaccccctgctcccgcccacctgacccctgccaaggccctggggttttaaactgagctcacatagggccttgtggaagaagtactgggtgctggagggagagctcggggcccagcccatgccccacacgggcaagcagcccactgatctgttttgtagctgaggttttgcatacggttttgtttggaggatggcttctgctgctaaaaatacaaaagtttggaaaccgctgctcttggaggatgaggtttcttggcatttctcaagattgggagctgtttgaaaggttgcccatcctcttccctcatgccttggggagtgagggacctctgctgtccttattggctgagtgagggtgttgattggccgtggaggggtccctttcagccctgatcatctaaggtgggggaggtggcttcatgatgaggggagaagtcagcaccagagtgacccccagtacccccactgactaaactgtgatcctaccctcaccaggcctcagttgccc

SEQ ID NO: 335813 - DNA, 717 bp, Homo sapiens
catggtggcagatgcctgtaatcccagctactgtgggaggctgaggcaggggaatcacttgaacctaggaggcagaggttgccatgagccgagatcatgccactgcactccagcctgggcgacagagtgagactcaatctcaaaaaaaataaataaataaaaatattaataatttgaaaaaaaaagctatacagaatgcaatgtatatgcctaaacaacgttaatttagaaatttaaaaagataatttttaaaatggtttcacttttttggatttactccaggtaagtgatttgattttttgttctacctaaacagcactggatataattatttcccagggcttcaaaattctgaaaatcctaattccctattgaagcactttttttttctaaaatagctaattactaaattataacaaacatagaagttgaatttggcaagttatggtagtttgcttctaggtcctcctttgatataaatatgttttccatatttgcctcatactcaatagttttctaaatttagcccaggaaacataccactattattattattattactgttattattttgttaaaggtttttctgtatttatcatgttttgaaaaagaaaaacggtcaaattctagatcctttaaaatccagtccattattattccatttattttaataataataataaatatttaaacctggtaagttttccgagtatatca

SEQ ID NO: 335814 - DNA, 612 bp, Homo sapiens
gtgcaatgaagaaattgcacacaagaacaagctacggtctgtcctctatgctgatgttggcagcctgcttctgcagaacatgcttaactggctatctgaggaccagaggggaagacagccgaccccaccacttctgagaccctatcttgcagccttatgaaaggagaagttatgcttaattcttggggaaacaaaggaatggctacaccagtaagttagccttaccattgacttgggactctgagaagtggagatggggacaacagtaatggggacagatgaacaatgtctcttgctttaggttcagcagggactcttgagaagtggagatggggacaacagtaatggggacagatgaacaatgtctcttgctttaggttcagcagtcagagacccaggcaccaagcgagaaggaactcagcctactgaaataacttcttaggtcaattcctggatccagtatttcctcagtgccatccattctacagtccagattaatcctccctaaaaacctttccaacatgccactgaagtactctaattggctcctcctgatatcctatcaaaatgggcttctaattcgacctaacttattttacagaagaagctgag

SEQ ID NO: 335815 - DNA, 5787 bp, Homo sapiens
tagtcatagccgatacctagaggtcaccccgtctatctactgaatacgtctttaagctttagcgtaacagattcttttcaatcaagtactggaatcagttgtccaggtggagtaatacagaaaagctaaggtctagaaaccaggggaccattttagatacaaagcagaattgcggaattgccagattataacttgaggtttgttcgggggattttttttaaccatctaaaataaatgtatataagatggactgagtcttctaaagagattctaaaactatattcttacttaagtctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttctgccaataaagttgcatggtaaatatttcattacagaatttatgttagagctttcatgccaagaatgttttcttacaaaattctctttttattgaggtttcactaataagcagcttctacttttgagcctcaacttaaagcagaactgttttctactggatttttcattaacagcaagctttttcttttatgtaaaataaatctattgtgaattgatatcagcgactcatttattaggtataaataatagccaaagaataaaattaaaatttattttaaactttcggtcttaaaaagagctgtaggatataaacctcttttgtgaaaagtagaattttctgaatgctttcatagacaaaaacgcatttaaactatgtttacctggttttccaacagaaatcaaatgattttaatattatgttttgatgggttattttcagagttgtttggttttttaaacactactgaatggtttcttttaaatttaagaacaactagttcttgaaaagcaataccgtatttctctgataaatttgtagttaaggttctagaaaatctaggacaaatttacttcattaaacataaagtttttaagattattcagttggcacaatttaatgcataattgggattggatccatttactgtactgtggtacagtaaagagaatgtgttcttattgaacagcagatttgtatacaaatacggaataatgcaactacattataaattgtatacgaacaaaataaattgggtcactctgagcttactattaaaacattgaaaatttattaatgaacacaggctatcttgatgaggatctctgcttatgaaacacatactaatgaaattattagtgacacattggaagctagaaaattgctgttggggccattgctataaatcattgtttccatgttaagacttctgttctaattcattcattcaacaaacatttgttgagggccagatactgtgctggtcaactggggatactgtcctgaacaatatgcacacagttcttgcccctgcagagcttaaagaccattaaaggatacagaaaattaagcaattatcctatagtaggattcgtggtgtgatggggaaaatacaaggtactgtatttgggagtcatgtaactccagttttgggagtgagagagggtctggggaagaactgttccagataaaaagatgtgtaaccaagatagcatagcacattctgacaactaaagcaatttactctaacttaagcatgaagtacaaaagtatagttcatttattgagggaatgttaagctattaaaatgatactttttggtacttttaaaaaaatgaatacttaaacaccgttttaaaattttgtgttaagagctcctaataagaacttggtaaacatgttgacaatttaactcacagtctaaactttaaaagtagtagttacccttttatttctgtgccatgagacaaattcttctgcagttttatagttgtacaagatgttttgactcactctcaattgccatattcttaaagaaaccctgaaaagctgctcaagctggtcagttttctgtaaaaccaagtaaatgaaattttctctcccctcagaaaggaagttctacagcctagagtaccatctattgtgttttataagtccagatttaggctttgaaagatcataccaaaacttcagatcgacttaaacagcaactatgaattaggtttatgggaaatgtagtaatacaggggaaagaatatcggtaatggagtgaaatggtcctgggttcaaatccagtcttcctcacatattgtgctctttaagcttcaaatgagatgtataactgccttttccttaccagtaaaatgaggacaataattatgacaccatagggtggttgtgaggattagcaaatgttatcttgtatttcaggtgcctttcagggaaaggcttggcacatagtaaacacatcctgtaaatatcagtttccccttgttagcccctgtagcatcctgacctaccaagtctataggccttgcatatcactgtgcaccagagatacctcttttacatctgggctctgttttctctctatcaatcctatcctccaccctctttaaatcagaccccaggtttaaccttcccacagtcagtataaatcatttttcagaactttcagctttccatcaagtgaaagttgattttagttacccagtaatgtacagaaaccttcaataatgttaagcttcaaaggcttctggtacgtttgtctaccacagaaccaccacaatatatatgcttgttcttaggtttattgctttttattttaatggggtttggttgtttgggttttattttggttttggcttattttaaagtcaagtttagtttttactcaggtaaaggcctgaagtttcttgggcgtggaagaaaaagcttgggaagcctattaattcatggtgcagttcagaattgtttaaataagctctgtgccactgagcttaatctgaaagtatagtgacatgtgaaggatgcacatatgaatgaaaaactaaaataattgtaggctcttctataaatgaaaaaaaaagtgattggattgtgtctacctttttcctcaaagtaatctaacctaaacggtcatggtgttaaaactttttatggtgctaatcagaaaaattgatgttgcaagaaatgaggtctcaaaaatgggaatgtgcctcctcactctgcgtcacatgggaaataaatcctgaggccaggatcaccagtggggtagagtcatcttcatagtctcctgttatcctccccctgaacaaagaacaaagtgagactgggaagctagtgttggggaaacatttctgggataaactgtggagtggagaagacaatggagggcaaggcaaaaacccacagacttgtttacccatagaggccccactcacctccatgctgacagaattccagaaaaattccttccctatctcccaaacacctgaaattctgaaatattgccctactatttagcactttaagcttcagtgaggtgctgtaatggagagatagcttcatagtttagcctatagccaactttgcctcaagacctccagataagatgaagtggcttttacctcatgtgagtctcaaacgctggagagagagttccacaaccacccctgccctttctcccatattacgctcattagaaagtctactcagggctgggtgccgtggctcatgcctgtaatcccagcactttggaggctgaggcgggtggatcatctgaggtcaggagttcgagaccagcctggccaacatggggaaaccctgtctctactgaaaatataaaaattagccgggcatggtggcgtgcacctgtaattccagctactcgggaggctgaggcaggagaatcacttgaaccccagaggcagaggctacagtgagccaagattgcaccactgcactccaacctgggtgatagaataagactcttgtctcaaggaaagaaaaaatgtctactcagtagagcagtgattggcaaagtgtgagaccccagaccggcaatattggcatctcctggagacttgtttaaaatgctgattactattttcaagaactttctaccttcatttttacttattttttgttttcaagggctcatggaatcagtcttccatgtgacagctttttaaatattttaagacaaaaactgagtcttctaatcttaattgtgttctagcagtagtcattgtaattatagttatttttataatttatttgtttagtgtatatctgtcactctagaatgtaggctccctgagataaaaactataattcttttgatggcagttacattcccaactcttagcacaagatctaggacatagtatgaactcaataaatttttgttgaatgaaagaaaaatgcaaatttataagccttttcagagacctactgaatcaaactctgagagtggagcccagcaatctgttgtaaaagctgtttgagtaatactgttgcactctaagcttgagaaccactgcaatagaactaagagaacattcatttcaccttcaggcctattctctgacatcacttgaaaaatcctctctgccttctgtaacccttaaccaacaacagtgccctgtccatgtaggggaaacttctgggctgtattacaagtgggtaggaaggtataaggatatcatagtgggaagtattgcttagaatgccagtacttgtttgctgtggaaggtttctaggaatggattgcttagtctaaagtaagcactaccaccatccacgttttcactcaacacagtgccttttaattggtgactaacatcaaaacaccttgacaaaccgttaaaacagtatcagaaaccatgtgtacatccctgtgcctcttagattgctaagttctgctctcattcttacttcaaaggacactttttaaagaattgttaatgcttttttataatacaagtcatagccctgttggcaaaaagaaaaaagattcagtgagaaagaaaaatcactgataattccatcatccagggagaaccactgttatttaagtatatggccttccagacttttctgtgcatttatagatatttttaatgggatcaaagtgtacatactgttttgtaactttttttcactcaacaataccatgactgtcttgctgtgtcaagtatatttctacatctcttaatggctgcatgatattccatcatatgtgccacattttattaaactactgttcaatttttaggtttccaactttcattaataaagtgctttaaagaacattgtgttgctaaatctc

SEQ ID NO: 335816 - DNA, 1805 bp, Homo sapiens
cgcttgtttttcccttgggacccgggtccacacggcggggtcgcccgtccatctccggctcgcccgcggggcccatcgtcgacgttagcggccgttctccgagccgactgacccatccttggcgctgccgccgcgcgcttgttctcctccctcgccccgccttcatcctccccgttcacggaaacgacagctgcggctgcggggctggcgccgcctccctccacctaccacgtctgccctcgccgctctagccctgcgccccagcccggccgcggcacctccgcctcgccgccgctaggtcggccggctccgcccggctgccgcctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttctgccaataaagttgcatggtaaatatttcattacagaatttatgttagagctttcatgccaagaatgttttcttacaaaattctctttttattgaggtttcactaataagcagcttctacttttgagcctcaacttaaagcagaactgttttctactggatttttcattaacagcaagctttttcttttatgtaaaataaatctattgtgaaaaaaaaaaaaaaaagagaattttgtaagaa

SEQ ID NO: 335817 - DNA, 1402 bp, Homo sapiens
tagaggaatgaagaatgtcttacatcagataagaccagtgacttgggtaagatgatgattaccaggccagtagcgagcagagtacttcggggcactctaacacttgtagagtttgctaatcactgctcgtactatacgaatctggcgacagaaactggtgccggagccttttcagtgtttaaacttctagttctcattgctctgacaccgggctacactggcaattgctgactaccactgtgacagacatatttcaacctgaagtttcctcgcacaaaaactgagtcttctaatcttaattgtgttctagcagtagtcattgtaattatagttatttttataatttatttgtttagtgtatatctgtcactctagaatgtaggctccctgagataaaaactataattcttttgatggcagttacattcccaactcttagcacaagatctaggacatagtatgaactcaataaatttttgttgaatgaaagaaaaatgcaaatttataagccttttcagagacctactgaatcaaactctgagagtggagcccagcaatctgttgtaaaagctgtttgagtaatactgttgcactctaagcttgagaaccactgcaatagaactaagagaacattcatttcaccttcaggcctattctctgacatcacttgaaaaatcctctctgccttctgtaacccttaaccaacaacagtgccctgtccatgtaggggaaacttctgggctgtattacaagtgggtaggaaggtataaggatatcatagtgggaagtattgcttagaatgccagtacttgtttgctgtggaaggtttctaggaatggattgcttagtctaaagtaagcactaccaccatccacgttttcactcaacacagtgccttttaattggtgactaacatcaaaacaccttgacaaaccgttaaaacagtatcagaaaccatgtgtacatccctgtgcctcttagattgctaagttctgctctcattcttacttcaaaggacactttttaaagaattgttaatgcttttttataatacaagtcatagccctgttggcaaaaagaaaaaagattcagtgagaaagaaaaatcactgataattccatcatccagggagaaccactgttatttaagtatatggccttccagacttttctgtgcatttatagatatttttaatgggatcaaagtgtacatactgttttgtaactttttttcactcaacaataccatgactgtcttgctgtgtcaagtatatttctacatctcttaatggctgcatgatattccatcatatgtgccacattttattaaactactgttcaatttttaggtttccaactttcattaataaagtgctttaaagaacattgtgttgctaaatctc

SEQ ID NO: 335818 - DNA, 4237 bp, Homo sapiens
cgcttgtttttcccttgggacccgggtccacacggcggggtcgcccgtccatctccggctcgcccgcggggcccatcgtcgacgttagcggccgttctccgagccgactgacccatccttggcgctgccgccgcgcgcttgttctcctccctcgccccgccttcatcctccccgttcacggaaacgacagctgcggctgcggggctggcgccgcctccctccacctaccacgtctgccctcgccgctctagccctgcgccccagcccggccgcggcacctccgcctcgccgccgctaggtcggccggctccgcccggctgccgcctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttctgccaataaagttgcatggtaaatatttcattacagaatttatgttagagctttcatgccaagaatgttttcttacaaaattctctttttattgaggtttcactaataagcagcttctacttttgagcctcaacttaaagcagaactgttttctactggatttttcattaacagcaagctttttcttttatgtaaaataaatctattgtgaattgatatcagcgactcatttattaggtataaataatagccaaagaataaaattaaaatttattttaaactttcggtcttaaaaagagctgtaggatataaacctcttttgtgaaaagtagaattttctgaatgctttcatagacaaaaacgcatttaaactatgtttacctggttttccaacagaaatcaaatgattttaatattatgttttgatgggttattttcagagttgtttggttttttaaacactactgaatggtttcttttaaatttaagaacaactagttcttgaaaagcaataccgtatttctctgataaatttgtagttaaggttctagaaaatctaggacaaatttacttcattaaacataaagtttttaagattattcagttggcacaatttaatgcataattgggattggatccatttactgtactgtggtacagtaaagagaatgtgttcttattgaacagcagatttgtatacaaatacggaataatgcaactacattataaattgtatacgaacaaaataaattgggtcactctgagcttactattaaaacattgaaaatttattaatgaacacaggctatcttgatgaggatctctgcttatgaaacacatactaatgaaattattagtgacacattggaagctagaaaattgctgttggggccattgctataaaagcttcatagtttagcctatagccaactttgcctcaagacctccagataagatgaagtggcttttacctcatgtgagtctcaaacgctggagagagagttccacaaccacccctgccctttctcccatattacgctcattagaaagtctactcagggctgggtgccgtggctcatgcctgtaatcccagcactttggaggctgaggcgggtggatcatctgaggtcaggagttcgagaccagcctggccaacatggggaaaccctgtctctactgaaaatataaaaattagccgggcatggtggcgtgcacctgtaattccagctactcgggaggctgaggcaggagaatcacttgaaccccagaggcagaggctacagtgagccaagattgcaccactgcactccaacctgggtgatagaataagactcttgtctcaaggaaagaaaaaatgtctactcagtagagcagtgattggcaaagtgtgagaccccagaccggcaatattggcatctcctggagacttgtttaaaatgctgattactattttcaagaactttctaccttcatttttacttattttttgttttcaagggctcatggaatcagtcttccatgtgacagctttttaaatattttaagacaaaaactgagtcttctaatcttaattgtgttctagcagtagtcattgtaattatagttatttttataatttatttgtttagtgtatatctgtcactctagaatgtaggctccctgagataaaaactataattcttttgatggcagttacattcccaactcttagcacaagatctaggacatagtatgaactcaataaatttttgttgaatgaaagaaaaatgcaaatttataagccttttcagagacctactgaatcaaactctgagagtggagcccagcaatctgttgtaaaagctgtttgagtaatactgttgcactctaagcttgagaaccactgcaatagaactaagagaacattcatttcaccttcaggcctattctctgacatcacttgaaaaatcctctctgccttctgtaacccttaaccaacaacagtgccctgtccatgtaggggaaacttctgggctgtattacaagtgggtaggaaggtataaggatatcatagtgggaagtattgcttagaatgccagtacttgtttgctgtggaaggtttctaggaatggattgcttagtctaaagtaagcactaccaccatccacgttttcactcaacacagtgccttttaattggtgactaacatcaaaacaccttgacaaaccgttaaaacagtatcagaaaccatgtgtacatccctgtgcctcttagattgctaagttctgctctcattcttacttcaaaggacactttttaaagaattgttaatgcttttttataatacaagtcatagccctgttggcaaaaagaaaaaagattcagtgagaaagaaaaatcactgataattccatcatccagggagaaccactgttatttaagtatatggccttccagacttttctgtgcatttatagatatttttaatgggatcaaagtgtacatactgttttgtaactttttttcactcaacaataccatgactgtcttgctgtgtcaagtatatttctacatctcttaatggctgcatgatattccatcatatgtgccacattttattaaactactgttcaatttttaggtttccaactttcattaataaagtgctttaaagaacattgtgttgctaaatctc

SEQ ID NO: 335819 - DNA, 6251 bp, Homo sapiens
cgcttgtttttcccttgggacccgggtccacacggcggggtcgcccgtccatctccggctcgcccgcggggcccatcgtcgacgttagcggccgttctccgagccgactgacccatccttggcgctgccgccgcgcgcttgttctcctccctcgccccgccttcatcctccccgttcacggaaacgacagctgcggctgcggggctggcgccgcctccctccacctaccacgtctgccctcgccgctctagccctgcgccccagcccggccgcggcacctccgcctcgccgccgctaggtcggccggctccgcccggctgccgcctaggatgaatatcatggacttcaacgtgaagaagctggcggccgacgcaggcaccttcctcagtcgcgccgtgcagatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttctgccaataaagttgcatggtaaatatttcattacagaatttatgttagagctttcatgccaagaatgttttcttacaaaattctctttttattgaggtttcactaataagcagcttctacttttgagcctcaacttaaagcagaactgttttctactggatttttcattaacagcaagctttttcttttatgtaaaataaatctattgtgaattgatatcagcgactcatttattaggtataaataatagccaaagaataaaattaaaatttattttaaactttcggtcttaaaaagagctgtaggatataaacctcttttgtgaaaagtagaattttctgaatgctttcatagacaaaaacgcatttaaactatgtttacctggttttccaacagaaatcaaatgattttaatattatgttttgatgggttattttcagagttgtttggttttttaaacactactgaatggtttcttttaaatttaagaacaactagttcttgaaaagcaataccgtatttctctgataaatttgtagttaaggttctagaaaatctaggacaaatttacttcattaaacataaagtttttaagattattcagttggcacaatttaatgcataattgggattggatccatttactgtactgtggtacagtaaagagaatgtgttcttattgaacagcagatttgtatacaaatacggaataatgcaactacattataaattgtatacgaacaaaataaattgggtcactctgagcttactattaaaacattgaaaatttattaatgaacacaggctatcttgatgaggatctctgcttatgaaacacatactaatgaaattattagtgacacattggaagctagaaaattgctgttggggccattgctataaatcattgtttccatgttaagacttctgttctaattcattcattcaacaaacatttgttgagggccagatactgtgctggtcaactggggatactgtcctgaacaatatgcacacagttcttgcccctgcagagcttaaagaccattaaaggatacagaaaattaagcaattatcctatagtaggattcgtggtgtgatggggaaaatacaaggtactgtatttgggagtcatgtaactccagttttgggagtgagagagggtctggggaagaactgttccagataaaaagatgtgtaaccaagatagcatagcacattctgacaactaaagcaatttactctaacttaagcatgaagtacaaaagtatagttcatttattgagggaatgttaagctattaaaatgatactttttggtacttttaaaaaaatgaatacttaaacaccgttttaaaattttgtgttaagagctcctaataagaacttggtaaacatgttgacaatttaactcacagtctaaactttaaaagtagtagttacccttttatttctgtgccatgagacaaattcttctgcagttttatagttgtacaagatgttttgactcactctcaattgccatattcttaaagaaaccctgaaaagctgctcaagctggtcagttttctgtaaaaccaagtaaatgaaattttctctcccctcagaaaggaagttctacagcctagagtaccatctattgtgttttataagtccagatttaggctttgaaagatcataccaaaacttcagatcgacttaaacagcaactatgaattaggtttatgggaaatgtagtaatacaggggaaagaatatcggtaatggagtgaaatggtcctgggttcaaatccagtcttcctcacatattgtgctctttaagcttcaaatgagatgtataactgccttttccttaccagtaaaatgaggacaataattatgacaccatagggtggttgtgaggattagcaaatgttatcttgtatttcaggtgcctttcagggaaaggcttggcacatagtaaacacatcctgtaaatatcagtttccccttgttagcccctgtagcatcctgacctaccaagtctataggccttgcatatcactgtgcaccagagatacctcttttacatctgggctctgttttctctctatcaatcctatcctccaccctctttaaatcagaccccaggtttaaccttcccacagtcagtataaatcatttttcagaactttcagctttccatcaagtgaaagttgattttagttacccagtaatgtacagaaaccttcaataatgttaagcttcaaaggcttctggtacgtttgtctaccacagaaccaccacaatatatatgcttgttcttaggtttattgctttttattttaatggggtttggttgtttgggttttattttggttttggcttattttaaagtcaagtttagtttttactcaggtaaaggcctgaagtttcttgggcgtggaagaaaaagcttgggaagcctattaattcatggtgcagttcagaattgtttaaataagctctgtgccactgagcttaatctgaaagtatagtgacatgtgaaggatgcacatatgaatgaaaaactaaaataattgtaggctcttctataaatgaaaaaaaaagtgattggattgtgtctacctttttcctcaaagtaatctaacctaaacggtcatggtgttaaaactttttatggtgctaatcagaaaaattgatgttgcaagaaatgaggtctcaaaaatgggaatgtgcctcctcactctgcgtcacatgggaaataaatcctgaggccaggatcaccagtggggtagagtcatcttcatagtctcctgttatcctccccctgaacaaagaacaaagtgagactgggaagctagtgttggggaaacatttctgggataaactgtggagtggagaagacaatggagggcaaggcaaaaacccacagacttgtttacccatagaggccccactcacctccatgctgacagaattccagaaaaattccttccctatctcccaaacacctgaaattctgaaatattgccctactatttagcactttaagcttcagtgaggtgctgtaatggagagatagcttcatagtttagcctatagccaactttgcctcaagacctccagataagatgaagtggcttttacctcatgtgagtctcaaacgctggagagagagttccacaaccacccctgccctttctcccatattacgctcattagaaagtctactcagggctgggtgccgtggctcatgcctgtaatcccagcactttggaggctgaggcgggtggatcatctgaggtcaggagttcgagaccagcctggccaacatggggaaaccctgtctctactgaaaatataaaaattagccgggcatggtggcgtgcacctgtaattccagctactcgggaggctgaggcaggagaatcacttgaaccccagaggcagaggctacagtgagccaagattgcaccactgcactccaacctgggtgatagaataagactcttgtctcaaggaaagaaaaaatgtctactcagtagagcagtgattggcaaagtgtgagaccccagaccggcaatattggcatctcctggagacttgtttaaaatgctgattactattttcaagaactttctaccttcatttttacttattttttgttttcaagggctcatggaatcagtcttccatgtgacagctttttaaatattttaagacaaaaactgagtcttctaatcttaattgtgttctagcagtagtcattgtaattatagttatttttataatttatttgtttagtgtatatctgtcactctagaatgtaggctccctgagataaaaactataattcttttgatggcagttacattcccaactcttagcacaagatctaggacatagtatgaactcaataaatttttgttgaatgaaagaaaaatgcaaatttataagccttttcagagacctactgaatcaaactctgagagtggagcccagcaatctgttgtaaaagctgtttgagtaatactgttgcactctaagcttgagaaccactgcaatagaactaagagaacattcatttcaccttcaggcctattctctgacatcacttgaaaaatcctctctgccttctgtaacccttaaccaacaacagtgccctgtccatgtaggggaaacttctgggctgtattacaagtgggtaggaaggtataaggatatcatagtgggaagtattgcttagaatgccagtacttgtttgctgtggaaggtttctaggaatggattgcttagtctaaagtaagcactaccaccatccacgttttcactcaacacagtgccttttaattggtgactaacatcaaaacaccttgacaaaccgttaaaacagtatcagaaaccatgtgtacatccctgtgcctcttagattgctaagttctgctctcattcttacttcaaaggacactttttaaagaattgttaatgcttttttataatacaagtcatagccctgttggcaaaaagaaaaaagattcagtgagaaagaaaaatcactgataattccatcatccagggagaaccactgttatttaagtatatggccttccagacttttctgtgcatttatagatatttttaatgggatcaaagtgtacatactgttttgtaactttttttcactcaacaataccatgactgtcttgctgtgtcaagtatatttctacatctcttaatggctgcatgatattccatcatatgtgccacattttattaaactactgttcaatttttaggtttccaactttcattaataaagtgctttaaagaacattgtgttgctaaatctc

SEQ ID NO: 335820 - DNA, 6041 bp, Homo sapiens
aagaatcctttgaatgaacctaaaaactggtgctagcaacaagtgtttggcaactaaacgcaaggtgaaaatcctatggcttcactctaaagtcttttgcatttgagactgaagactctttaacttcaaagtaaaaactgtagtaataattgagaatttttgcagcaatattactttatacttgtaaaactggtcatcttaaaattttgtaaaatagtaaaatttagcaaaattgatactagaaaatttatgaaaatatcttggctttctcttagtagtttttgtaggctcttaagagtgtatcattaagctttagcgtaacagattcttttcaatcaagtactggaatcagttgtccaggtggagtaatacagaaaagctaaggtctagaaaccaggggaccattttagatacaaagcagaattgcggaattgccagattataacttgaggtttgttcgggggattttttttaaccatctaaaataaatgtatataagatggactgagtcttctaaagagattctaaaactatattcttacttaagtctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttctgccaataaagttgcatggtaaatatttcattacagaatttatgttagagctttcatgccaagaatgttttcttacaaaattctctttttattgaggtttcactaataagcagcttctacttttgagcctcaacttaaagcagaactgttttctactggatttttcattaacagcaagctttttcttttatgtaaaataaatctattgtgaattgatatcagcgactcatttattaggtataaataatagccaaagaataaaattaaaatttattttaaactttcggtcttaaaaagagctgtaggatataaacctcttttgtgaaaagtagaattttctgaatgctttcatagacaaaaacgcatttaaactatgtttacctggttttccaacagaaatcaaatgattttaatattatgttttgatgggttattttcagagttgtttggttttttaaacactactgaatggtttcttttaaatttaagaacaactagttcttgaaaagcaataccgtatttctctgataaatttgtagttaaggttctagaaaatctaggacaaatttacttcattaaacataaagtttttaagattattcagttggcacaatttaatgcataattgggattggatccatttactgtactgtggtacagtaaagagaatgtgttcttattgaacagcagatttgtatacaaatacggaataatgcaactacattataaattgtatacgaacaaaataaattgggtcactctgagcttactattaaaacattgaaaatttattaatgaacacaggctatcttgatgaggatctctgcttatgaaacacatactaatgaaattattagtgacacattggaagctagaaaattgctgttggggccattgctataaatcattgtttccatgttaagacttctgttctaattcattcattcaacaaacatttgttgagggccagatactgtgctggtcaactggggatactgtcctgaacaatatgcacacagttcttgcccctgcagagcttaaagaccattaaaggatacagaaaattaagcaattatcctatagtaggattcgtggtgtgatggggaaaatacaaggtactgtatttgggagtcatgtaactccagttttgggagtgagagagggtctggggaagaactgttccagataaaaagatgtgtaaccaagatagcatagcacattctgacaactaaagcaatttactctaacttaagcatgaagtacaaaagtatagttcatttattgagggaatgttaagctattaaaatgatactttttggtacttttaaaaaaatgaatacttaaacaccgttttaaaattttgtgttaagagctcctaataagaacttggtaaacatgttgacaatttaactcacagtctaaactttaaaagtagtagttacccttttatttctgtgccatgagacaaattcttctgcagttttatagttgtacaagatgttttgactcactctcaattgccatattcttaaagaaaccctgaaaagctgctcaagctggtcagttttctgtaaaaccaagtaaatgaaattttctctcccctcagaaaggaagttctacagcctagagtaccatctattgtgttttataagtccagatttaggctttgaaagatcataccaaaacttcagatcgacttaaacagcaactatgaattaggtttatgggaaatgtagtaatacaggggaaagaatatcggtaatggagtgaaatggtcctgggttcaaatccagtcttcctcacatattgtgctctttaagcttcaaatgagatgtataactgccttttccttaccagtaaaatgaggacaataattatgacaccatagggtggttgtgaggattagcaaatgttatcttgtatttcaggtgcctttcagggaaaggcttggcacatagtaaacacatcctgtaaatatcagtttccccttgttagcccctgtagcatcctgacctaccaagtctataggccttgcatatcactgtgcaccagagatacctcttttacatctgggctctgttttctctctatcaatcctatcctccaccctctttaaatcagaccccaggtttaaccttcccacagtcagtataaatcatttttcagaactttcagctttccatcaagtgaaagttgattttagttacccagtaatgtacagaaaccttcaataatgttaagcttcaaaggcttctggtacgtttgtctaccacagaaccaccacaatatatatgcttgttcttaggtttattgctttttattttaatggggtttggttgtttgggttttattttggttttggcttattttaaagtcaagtttagtttttactcaggtaaaggcctgaagtttcttgggcgtggaagaaaaagcttgggaagcctattaattcatggtgcagttcagaattgtttaaataagctctgtgccactgagcttaatctgaaagtatagtgacatgtgaaggatgcacatatgaatgaaaaactaaaataattgtaggctcttctataaatgaaaaaaaaagtgattggattgtgtctacctttttcctcaaagtaatctaacctaaacggtcatggtgttaaaactttttatggtgctaatcagaaaaattgatgttgcaagaaatgaggtctcaaaaatgggaatgtgcctcctcactctgcgtcacatgggaaataaatcctgaggccaggatcaccagtggggtagagtcatcttcatagtctcctgttatcctccccctgaacaaagaacaaagtgagactgggaagctagtgttggggaaacatttctgggataaactgtggagtggagaagacaatggagggcaaggcaaaaacccacagacttgtttacccatagaggccccactcacctccatgctgacagaattccagaaaaattccttccctatctcccaaacacctgaaattctgaaatattgccctactatttagcactttaagcttcagtgaggtgctgtaatggagagatagcttcatagtttagcctatagccaactttgcctcaagacctccagataagatgaagtggcttttacctcatgtgagtctcaaacgctggagagagagttccacaaccacccctgccctttctcccatattacgctcattagaaagtctactcagggctgggtgccgtggctcatgcctgtaatcccagcactttggaggctgaggcgggtggatcatctgaggtcaggagttcgagaccagcctggccaacatggggaaaccctgtctctactgaaaatataaaaattagccgggcatggtggcgtgcacctgtaattccagctactcgggaggctgaggcaggagaatcacttgaaccccagaggcagaggctacagtgagccaagattgcaccactgcactccaacctgggtgatagaataagactcttgtctcaaggaaagaaaaaatgtctactcagtagagcagtgattggcaaagtgtgagaccccagaccggcaatattggcatctcctggagacttgtttaaaatgctgattactattttcaagaactttctaccttcatttttacttattttttgttttcaagggctcatggaatcagtcttccatgtgacagctttttaaatattttaagacaaaaactgagtcttctaatcttaattgtgttctagcagtagtcattgtaattatagttatttttataatttatttgtttagtgtatatctgtcactctagaatgtaggctccctgagataaaaactataattcttttgatggcagttacattcccaactcttagcacaagatctaggacatagtatgaactcaataaatttttgttgaatgaaagaaaaatgcaaatttataagccttttcagagacctactgaatcaaactctgagagtggagcccagcaatctgttgtaaaagctgtttgagtaatactgttgcactctaagcttgagaaccactgcaatagaactaagagaacattcatttcaccttcaggcctattctctgacatcacttgaaaaatcctctctgccttctgtaacccttaaccaacaacagtgccctgtccatgtaggggaaacttctgggctgtattacaagtgggtaggaaggtataaggatatcatagtgggaagtattgcttagaatgccagtacttgtttgctgtggaaggtttctaggaatggattgcttagtctaaagtaagcactaccaccatccacgttttcactcaacacagtgccttttaattggtgactaacatcaaaacaccttgacaaaccgttaaaacagtatcagaaaccatgtgtacatccctgtgcctcttagattgctaagttctgctctcattcttacttcaaaggacactttttaaagaattgttaatgcttttttataatacaagtcatagccctgttggcaaaaagaaaaaagattcagtgagaaagaaaaatcactgataattccatcatccagggagaaccactgttatttaagtatatggccttccagacttttctgtgcatttatagatatttttaatgggatcaaagtgtacatactgttttgtaactttttttcactcaacaataccatgactgtcttgctgtgtcaagtatatttctacatctcttaatggctgcatgatattccatcatatgtgccacattttattaaactactgttcaatttttaggtttccaactttcattaataaagtgctttaaagaacattgtgttgctaaatctc

SEQ ID NO: 335821 - DNA, 6211 bp, Homo sapiens
cgcttgtttttcccttgggacccgggtccacacggcggggtcgcccgtccatctccggctcgcccgcggggcccatcgtcgacgttagcggccgttctccgagccgactgacccatccttggcgctgccgccgcgcgcttgttctcctccctcgccccgccttcatcctccccgttcacggaaacgacagctgcggctgcggggctggcgccgcctccctccacctaccacgtctgccctcgccgctctagccctgcgccccagcccggccgcggcacctccgcctcgccgccgctaggtcggccggctccgcccggctgccgcctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttctgccaataaagttgcatggtaaatatttcattacagaatttatgttagagctttcatgccaagaatgttttcttacaaaattctctttttattgaggtttcactaataagcagcttctacttttgagcctcaacttaaagcagaactgttttctactggatttttcattaacagcaagctttttcttttatgtaaaataaatctattgtgaattgatatcagcgactcatttattaggtataaataatagccaaagaataaaattaaaatttattttaaactttcggtcttaaaaagagctgtaggatataaacctcttttgtgaaaagtagaattttctgaatgctttcatagacaaaaacgcatttaaactatgtttacctggttttccaacagaaatcaaatgattttaatattatgttttgatgggttattttcagagttgtttggttttttaaacactactgaatggtttcttttaaatttaagaacaactagttcttgaaaagcaataccgtatttctctgataaatttgtagttaaggttctagaaaatctaggacaaatttacttcattaaacataaagtttttaagattattcagttggcacaatttaatgcataattgggattggatccatttactgtactgtggtacagtaaagagaatgtgttcttattgaacagcagatttgtatacaaatacggaataatgcaactacattataaattgtatacgaacaaaataaattgggtcactctgagcttactattaaaacattgaaaatttattaatgaacacaggctatcttgatgaggatctctgcttatgaaacacatactaatgaaattattagtgacacattggaagctagaaaattgctgttggggccattgctataaatcattgtttccatgttaagacttctgttctaattcattcattcaacaaacatttgttgagggccagatactgtgctggtcaactggggatactgtcctgaacaatatgcacacagttcttgcccctgcagagcttaaagaccattaaaggatacagaaaattaagcaattatcctatagtaggattcgtggtgtgatggggaaaatacaaggtactgtatttgggagtcatgtaactccagttttgggagtgagagagggtctggggaagaactgttccagataaaaagatgtgtaaccaagatagcatagcacattctgacaactaaagcaatttactctaacttaagcatgaagtacaaaagtatagttcatttattgagggaatgttaagctattaaaatgatactttttggtacttttaaaaaaatgaatacttaaacaccgttttaaaattttgtgttaagagctcctaataagaacttggtaaacatgttgacaatttaactcacagtctaaactttaaaagtagtagttacccttttatttctgtgccatgagacaaattcttctgcagttttatagttgtacaagatgttttgactcactctcaattgccatattcttaaagaaaccctgaaaagctgctcaagctggtcagttttctgtaaaaccaagtaaatgaaattttctctcccctcagaaaggaagttctacagcctagagtaccatctattgtgttttataagtccagatttaggctttgaaagatcataccaaaacttcagatcgacttaaacagcaactatgaattaggtttatgggaaatgtagtaatacaggggaaagaatatcggtaatggagtgaaatggtcctgggttcaaatccagtcttcctcacatattgtgctctttaagcttcaaatgagatgtataactgccttttccttaccagtaaaatgaggacaataattatgacaccatagggtggttgtgaggattagcaaatgttatcttgtatttcaggtgcctttcagggaaaggcttggcacatagtaaacacatcctgtaaatatcagtttccccttgttagcccctgtagcatcctgacctaccaagtctataggccttgcatatcactgtgcaccagagatacctcttttacatctgggctctgttttctctctatcaatcctatcctccaccctctttaaatcagaccccaggtttaaccttcccacagtcagtataaatcatttttcagaactttcagctttccatcaagtgaaagttgattttagttacccagtaatgtacagaaaccttcaataatgttaagcttcaaaggcttctggtacgtttgtctaccacagaaccaccacaatatatatgcttgttcttaggtttattgctttttattttaatggggtttggttgtttgggttttattttggttttggcttattttaaagtcaagtttagtttttactcaggtaaaggcctgaagtttcttgggcgtggaagaaaaagcttgggaagcctattaattcatggtgcagttcagaattgtttaaataagctctgtgccactgagcttaatctgaaagtatagtgacatgtgaaggatgcacatatgaatgaaaaactaaaataattgtaggctcttctataaatgaaaaaaaaagtgattggattgtgtctacctttttcctcaaagtaatctaacctaaacggtcatggtgttaaaactttttatggtgctaatcagaaaaattgatgttgcaagaaatgaggtctcaaaaatgggaatgtgcctcctcactctgcgtcacatgggaaataaatcctgaggccaggatcaccagtggggtagagtcatcttcatagtctcctgttatcctccccctgaacaaagaacaaagtgagactgggaagctagtgttggggaaacatttctgggataaactgtggagtggagaagacaatggagggcaaggcaaaaacccacagacttgtttacccatagaggccccactcacctccatgctgacagaattccagaaaaattccttccctatctcccaaacacctgaaattctgaaatattgccctactatttagcactttaagcttcagtgaggtgctgtaatggagagatagcttcatagtttagcctatagccaactttgcctcaagacctccagataagatgaagtggcttttacctcatgtgagtctcaaacgctggagagagagttccacaaccacccctgccctttctcccatattacgctcattagaaagtctactcagggctgggtgccgtggctcatgcctgtaatcccagcactttggaggctgaggcgggtggatcatctgaggtcaggagttcgagaccagcctggccaacatggggaaaccctgtctctactgaaaatataaaaattagccgggcatggtggcgtgcacctgtaattccagctactcgggaggctgaggcaggagaatcacttgaaccccagaggcagaggctacagtgagccaagattgcaccactgcactccaacctgggtgatagaataagactcttgtctcaaggaaagaaaaaatgtctactcagtagagcagtgattggcaaagtgtgagaccccagaccggcaatattggcatctcctggagacttgtttaaaatgctgattactattttcaagaactttctaccttcatttttacttattttttgttttcaagggctcatggaatcagtcttccatgtgacagctttttaaatattttaagacaaaaactgagtcttctaatcttaattgtgttctagcagtagtcattgtaattatagttatttttataatttatttgtttagtgtatatctgtcactctagaatgtaggctccctgagataaaaactataattcttttgatggcagttacattcccaactcttagcacaagatctaggacatagtatgaactcaataaatttttgttgaatgaaagaaaaatgcaaatttataagccttttcagagacctactgaatcaaactctgagagtggagcccagcaatctgttgtaaaagctgtttgagtaatactgttgcactctaagcttgagaaccactgcaatagaactaagagaacattcatttcaccttcaggcctattctctgacatcacttgaaaaatcctctctgccttctgtaacccttaaccaacaacagtgccctgtccatgtaggggaaacttctgggctgtattacaagtgggtaggaaggtataaggatatcatagtgggaagtattgcttagaatgccagtacttgtttgctgtggaaggtttctaggaatggattgcttagtctaaagtaagcactaccaccatccacgttttcactcaacacagtgccttttaattggtgactaacatcaaaacaccttgacaaaccgttaaaacagtatcagaaaccatgtgtacatccctgtgcctcttagattgctaagttctgctctcattcttacttcaaaggacactttttaaagaattgttaatgcttttttataatacaagtcatagccctgttggcaaaaagaaaaaagattcagtgagaaagaaaaatcactgataattccatcatccagggagaaccactgttatttaagtatatggccttccagacttttctgtgcatttatagatatttttaatgggatcaaagtgtacatactgttttgtaactttttttcactcaacaataccatgactgtcttgctgtgtcaagtatatttctacatctcttaatggctgcatgatattccatcatatgtgccacattttattaaactactgttcaatttttaggtttccaactttcattaataaagtgctttaaagaacattgtgttgctaaatctc

SEQ ID NO: 335822 - DNA, 1512 bp, Homo sapiens
cgcttgtttttcccttgggacccgggtccacacggcggggtcgcccgtccatctccggctcgcccgcggggcccatcgtcgacgttagcggccgttctccgagccgactgacccatccttggcgctgccgccgcgcgcttgttctcctccctcgccccgccttcatcctccccgttcacggaaacgacagctgcggctgcggggctggcgccgcctccctccacctaccacgtctgccctcgccgctctagccctgcgccccagcccggccgcggcacctccgcctcgccgccgctaggtcggccggctccgcccggctgccgcctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttcca

SEQ ID NO: 335823 - DNA, 936 bp, Homo sapiens
cgcttgtttttcccttgggacccgggtccacacggcggggtcgcccgtccatctccggctcgcccgcggggcccatcgtcgacgttagcggccgttctccgagccgactgacccatccttggcgctgccgccgcgcgcttgttctcctccctcgccccgccttcatcctccccgttcacggaaacgacagctgcggctgcggggctggcgccgcctccctccacctaccacgtctgccctcgccgctctagccctgcgccccagcccggccgcggcacctccgcctcgccgccgctaggtcggccggctccgcccggctgccgcctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaagcttgcgaaccttaaatttatttgacagaatttaaattacctcagggaattttttcggc

SEQ ID NO: 335824 - DNA, 196 bp, Homo sapiens
gtaagtgaaatgcaaaaagttctaataagggatatctttatgtttagatttattagagatgtcattaacatattagtaggccgggtgcagtggctcacacctgtaatcccagcactttgggtggttgaggtgggcggatcatgaggtcaggagatcgagactatcctggctaacatggtgaaaccccgtctctact

SEQ ID NO: 335825 - DNA, 826 bp, Homo sapiens
cttgaggccaggagttcaagaccagcctgggcaacatagcgacacctcatctctacaaaaaatatgaaaaattagctgggcatggtggtgtgcgcctgtagtcccagctactcaggaggctaaggtgggaggatcgtttgaacacgaaaggtcaaggctgcagtgagccgtgatcatgctgctgcactacagcctgggcaacagagtgagaccctgcctcaaaaaactaataataataaataaatcctttgtttttcagcacaattgataataacgtttaaagtccttttggtgaataatttaaacaaattaaatacaaatctgattggttttctacttgtttatttttttaatgtagttaataactggaagtattttattttgcaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttctgccaataaagttgcatggtaaatatttcattacagaatttatgttagagctttcatgccaagaatgttttcttacaaaattctctttttattgaggtttcactaataagcagcttctacttttgagcctcaacttaaagcagaactgttttctactggatttttcattaacagcaagctttttcttttatgtaa

SEQ ID NO: 335826 - DNA, 1035 bp, Homo sapiens
  misc_feature (944)..(944): n is a, c, g, or t
  misc_feature (964)..(964): n is a, c, g, or t
  misc_feature (982)..(982): n is a, c, g, or t
  misc_feature (997)..(997): n is a, c, g, or t
  misc_feature (1029)..(1029): n is a, c, g, or t
cgcttgtttttcccttgggacccgggtccacacggcggggtcgcccgtccatctccggctcgcccgcggggcccatcgtcgacgttagcggccgttctccgagccgactgacccatccttggcgctgccgccgcgcgcttgttctcctccctcgccccgccttcatcctccccgttcacggaaacgacagctgcggctgcggggctggcgccgcctccctccacctaccacgtctgccctcgccgctctagccctgcgccccagcccggccgcggcacctccgcctcgccgccgctaggtcggccggctccgcccggctgccgcctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcatctggaacaaggaattaagaataactcaaaaggtggaatttgatnggtcaaagcaagaggattancaagactttctgcctaanagggggaaatcaagnaagttacaacaatggcccaatcaaaccttcgnctggtc

SEQ ID NO: 335827 - DNA, 6393 bp, Homo sapiens
cgcttgtttttcccttgggacccgggtccacacggcggggtcgcccgtccatctccggctcgcccgcggggcccatcgtcgacgttagcggccgttctccgagccgactgacccatccttggcgctgccgccgcgcgcttgttctcctccctcgccccgccttcatcctccccgttcacggaaacgacagctgcggctgcggggctggcgccgcctccctccacctaccacgtctgccctcgccgctctagccctgcgccccagcccggccgcggcacctccgcctcgccgccgctaggtcggccggctccgcccggctgccgcctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttctgccaataaagttgcatggtaaatatttcattacagaatttatgttagagctttcatgccaagaatgttttcttacaaaattctctttttattgaggtttcactaataagcagcttctacttttgagcctcaacttaaagcagaactgttttctactggatttttcattaacagcaagctttttcttttatgtaaaataaatctattgtgaattgatatcagcgactcatttattaggtataaataatagccaaagaataaaattaaaatttattttaaactttcggtcttaaaaagagctgtaggatataaacctcttttgtgaaaagtagaattttctgaatgctttcatagacaaaaacgcatttaaactatgtttacctggttttccaacagaaatcaaatgattttaatattatgttttgatgggttattttcagagttgtttggttttttaaacactactgaatggtttcttttaaatttaagaacaactagttcttgaaaagcaataccgtatttctctgataaatttgtagttaaggttctagaaaatctaggacaaatttacttcattaaacataaagtttttaagattattcagttggcacaatttaatgcataattgggattggatccatttactgtactgtggtacagtaaagagaatgtgttcttattgaacagcagatttgtatacaaatacggaataatgcaactacattataaattgtatacgaacaaaataaattgggtcactctgagcttactattaaaacattgaaaatttattaatgaacacaggctatcttgatgaggatctctgcttatgaaacacatactaatgaaattattagtgacacattggaagctagaaaattgctgttggggccattgctataaatcattgtttccatgttaagacttctgttctaattcattcattcaacaaacatttgttgagggccagatactgtgctggtcaactggggatactgtcctgaacaatatgcacacagttcttgcccctgcagagcttaaagaccattaaaggatacagaaaattaagcaattatcctatagtaggattcgtggtgtgatggggaaaatacaaggtactgtatttgggagtcatgtaactccagttttgggagtgagagagggtctggggaagaactgttccagataaaaagatgtgtaaccaagatagcatagcacattctgacaactaaagcaatttactctaacttaagcatgaagtacaaaagtatagttcatttattgagggaatgttaagctattaaaatgatactttttggtacttttaaaaaaatgaatacttaaacaccgttttaaaattttgtgttaagagctcctaataagaacttggtaaacatgttgacaatttaactcacagtctaaactttaaaagtagtagttacccttttatttctgtgccatgagacaaattcttctgcagttttatagttgtacaagatgttttgactcactctcaattgccatattcttaaagaaaccctgaaaagctgctcaagctggtcagttttctgtaaaaccaagtaaatgaaattttctctcccctcagaaaggaagttctacagcctagagtaccatctattgtgttttataagtccagatttaggctttgaaagatcataccaaaacttcagatcgacttaaacagcaactatgaattaggtttatgggaaatgtagtaatacaggggaaagaatatcggtaatggagtgaaatggtcctgggttcaaatccagtcttcctcacatattgtgctctttaagcttcaaatgagatgtataactgccttttccttaccagtaaaatgaggacaataattatgacaccatagggtggttgtgaggattagcaaatgttatcttgtatttcaggtgcctttcagggaaaggcttggcacatagtaaacacatcctgtaaatatcagtttccccttgttagcccctgtagcatcctgacctaccaagtctataggccttgcatatcactgtgcaccagagatacctcttttacatctgggctctgttttctctctatcaatcctatcctccaccctctttaaatcagaccccaggtttaaccttcccacagtcagtataaatcatttttcagaactttcagctttccatcaagtgaaagttgattttagttacccagtaatgtacagaaaccttcaataatgttaagcttcaaaggcttctggtacgtttgtctaccacagaaccaccacaatatatatgcttgttcttaggtttattgctttttattttaatggggtttggttgtttgggttttattttggttttggcttattttaaagtcaagtttagtttttactcaggtaaaggcctgaagtttcttgggcgtggaagaaaaagcttgggaagcctattaattcatggtgcagttcagaattgtttaaataagctctgtgccactgagcttaatctgaaagtatagtgacatgtgaaggatgcacatatgaatgaaaaactaaaataattgtaggctcttctataaatgaaaaaaaaagtgattggattgtgtctacctttttcctcaaagtaatctaacctaaacggtcatggtgttaaaactttttatggtgctaatcagaaaaattgatgttgcaagaaatgaggtctcaaaaatgggaatgtgcctcctcactctgcgtcacatgggaaataaatcctgaggccaggatcaccagtggggtagagtcatcttcatagtctcctgttatcctccccctgaacaaagaacaaagtgagactgggaagctagtgttggggaaacatttctgggataaactgtggagtggagaagacaatggagggcaaggcaaaaacccacagacttgtttacccatagaggccccactcacctccatgctgacagaattccagaaaaattccttccctatctcccaaacacctgaaattctgaaatattgccctactatttagcactttaagcttcagtgaggtgctgtaatggagagatagcttcatagtttagcctatagccaactttgcctcaagacctccagataagatgaagtggcttttacctcatgtgagtctcaaacgctggagagagagttccacaaccacccctgccctttctcccatattacgctcattagaaagtctactcagggctgggtgccgtggctcatgcctgtaatcccagcactttggaggctgaggcgggtggatcatctgaggtcaggagttcgagaccagcctggccaacatggggaaaccctgtctctactgaaaatataaaaattagccgggcatggtggcgtgcacctgtaattccagctactcgggaggctgaggcaggagaatcacttgaaccccagaggcagaggctacagtgagccaagattgcaccactgcactccaacctgggtgatagaataagactcttgtctcaaggaaagaaaaaatgtctactcagtagagcagtgattggcaaagtgtgagaccccagaccggcaatattggcatctcctggagacttgtttaaaatgctgattactattttcaagaactttctaccttcatttttacttattttttgttttcaagggctcatggaatcagtcttccatgtgacagctttttaaatattttaagacaaaaactgagtcttctaatcttaattgtgttctagcagtagtcattgtaattatagttatttttataatttatttgtttagtgtatatctgtcactctagaatgtaggctccctgagataaaaactataattcttttgatggcagttacattcccaactcttagcacaagatctaggacatagtatgaactcaataaatttttgttgaatgaaagaaaaatgcaaatttataagccttttcagagacctactgaatcaaactctgagagtggagcccagcaatctgttgtaaaagctgtttgagtaatactgttgcactctaagcttgagaaccactgcaatagaactaagagaacattcatttcaccttcaggcctattctctgacatcacttgaaaaatcctctctgccttctgtaacccttaaccaacaacagtgccctgtccatgtaggggaaacttctgggctgtattacaagtgggtaggaaggtataaggatatcatagtgggaagtattgcttagaatgccagtacttgtttgctgtggaaggtttctaggaatggattgcttagtctaaagtaagcactaccaccatccacgttttcactcaacacagtgccttttaattggtgactaacatcaaaacaccttgacaaaccgttaaaacagtatcagaaaccatgtgtacatccctgtgcctcttagattgctaagttctgctctcattcttacttcaaaggacactttttaaagaattgttaatgcttttttataatacaagtcatagccctgttggcaaaaagaaaaaagattcagtgagaaagaaaaatcactgataattccatcatccagggagaaccactgttatttaagtatatggccttccagacttttctgtgcatttatagatatttttaatgggatcaaagtgtacatactgttttgtaactttttttcactcaacaataccatgactgtcttgctgtgtcaagtatatttctacatctcttaatggctgcatgatattccatcatatgtgccacattttattaaactactgttcaatttttaggtttccaactttcattaataaagtgctttaaagaacattgtgttgctaaatctc

SEQ ID NO: 335828 - DNA, 6456 bp, Homo sapiens
cgcttgtttttcccttgggacccgggtccacacggcggggtcgcccgtccatctccggctcgcccgcggggcccatcgtcgacgttagcggccgttctccgagccgactgacccatccttggcgctgccgccgcgcgcttgttctcctccctcgccccgccttcatcctccccgttcacggaaacgacagctgcggctgcggggctggcgccgcctccctccacctaccacgtctgccctcgccgctctagccctgcgccccagcccggccgcggcacctccgcctcgccgccgctaggtcggccggctccgcccggctgccgcctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcacaactaaactcagctcgccttgaaggagataacattatgatttgggcagaggaggtgacaaaatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttctgccaataaagttgcatggtaaatatttcattacagaatttatgttagagctttcatgccaagaatgttttcttacaaaattctctttttattgaggtttcactaataagcagcttctacttttgagcctcaacttaaagcagaactgttttctactggatttttcattaacagcaagctttttcttttatgtaaaataaatctattgtgaattgatatcagcgactcatttattaggtataaataatagccaaagaataaaattaaaatttattttaaactttcggtcttaaaaagagctgtaggatataaacctcttttgtgaaaagtagaattttctgaatgctttcatagacaaaaacgcatttaaactatgtttacctggttttccaacagaaatcaaatgattttaatattatgttttgatgggttattttcagagttgtttggttttttaaacactactgaatggtttcttttaaatttaagaacaactagttcttgaaaagcaataccgtatttctctgataaatttgtagttaaggttctagaaaatctaggacaaatttacttcattaaacataaagtttttaagattattcagttggcacaatttaatgcataattgggattggatccatttactgtactgtggtacagtaaagagaatgtgttcttattgaacagcagatttgtatacaaatacggaataatgcaactacattataaattgtatacgaacaaaataaattgggtcactctgagcttactattaaaacattgaaaatttattaatgaacacaggctatcttgatgaggatctctgcttatgaaacacatactaatgaaattattagtgacacattggaagctagaaaattgctgttggggccattgctataaatcattgtttccatgttaagacttctgttctaattcattcattcaacaaacatttgttgagggccagatactgtgctggtcaactggggatactgtcctgaacaatatgcacacagttcttgcccctgcagagcttaaagaccattaaaggatacagaaaattaagcaattatcctatagtaggattcgtggtgtgatggggaaaatacaaggtactgtatttgggagtcatgtaactccagttttgggagtgagagagggtctggggaagaactgttccagataaaaagatgtgtaaccaagatagcatagcacattctgacaactaaagcaatttactctaacttaagcatgaagtacaaaagtatagttcatttattgagggaatgttaagctattaaaatgatactttttggtacttttaaaaaaatgaatacttaaacaccgttttaaaattttgtgttaagagctcctaataagaacttggtaaacatgttgacaatttaactcacagtctaaactttaaaagtagtagttacccttttatttctgtgccatgagacaaattcttctgcagttttatagttgtacaagatgttttgactcactctcaattgccatattcttaaagaaaccctgaaaagctgctcaagctggtcagttttctgtaaaaccaagtaaatgaaattttctctcccctcagaaaggaagttctacagcctagagtaccatctattgtgttttataagtccagatttaggctttgaaagatcataccaaaacttcagatcgacttaaacagcaactatgaattaggtttatgggaaatgtagtaatacaggggaaagaatatcggtaatggagtgaaatggtcctgggttcaaatccagtcttcctcacatattgtgctctttaagcttcaaatgagatgtataactgccttttccttaccagtaaaatgaggacaataattatgacaccatagggtggttgtgaggattagcaaatgttatcttgtatttcaggtgcctttcagggaaaggcttggcacatagtaaacacatcctgtaaatatcagtttccccttgttagcccctgtagcatcctgacctaccaagtctataggccttgcatatcactgtgcaccagagatacctcttttacatctgggctctgttttctctctatcaatcctatcctccaccctctttaaatcagaccccaggtttaaccttcccacagtcagtataaatcatttttcagaactttcagctttccatcaagtgaaagttgattttagttacccagtaatgtacagaaaccttcaataatgttaagcttcaaaggcttctggtacgtttgtctaccacagaaccaccacaatatatatgcttgttcttaggtttattgctttttattttaatggggtttggttgtttgggttttattttggttttggcttattttaaagtcaagtttagtttttactcaggtaaaggcctgaagtttcttgggcgtggaagaaaaagcttgggaagcctattaattcatggtgcagttcagaattgtttaaataagctctgtgccactgagcttaatctgaaagtatagtgacatgtgaaggatgcacatatgaatgaaaaactaaaataattgtaggctcttctataaatgaaaaaaaaagtgattggattgtgtctacctttttcctcaaagtaatctaacctaaacggtcatggtgttaaaactttttatggtgctaatcagaaaaattgatgttgcaagaaatgaggtctcaaaaatgggaatgtgcctcctcactctgcgtcacatgggaaataaatcctgaggccaggatcaccagtggggtagagtcatcttcatagtctcctgttatcctccccctgaacaaagaacaaagtgagactgggaagctagtgttggggaaacatttctgggataaactgtggagtggagaagacaatggagggcaaggcaaaaacccacagacttgtttacccatagaggccccactcacctccatgctgacagaattccagaaaaattccttccctatctcccaaacacctgaaattctgaaatattgccctactatttagcactttaagcttcagtgaggtgctgtaatggagagatagcttcatagtttagcctatagccaactttgcctcaagacctccagataagatgaagtggcttttacctcatgtgagtctcaaacgctggagagagagttccacaaccacccctgccctttctcccatattacgctcattagaaagtctactcagggctgggtgccgtggctcatgcctgtaatcccagcactttggaggctgaggcgggtggatcatctgaggtcaggagttcgagaccagcctggccaacatggggaaaccctgtctctactgaaaatataaaaattagccgggcatggtggcgtgcacctgtaattccagctactcgggaggctgaggcaggagaatcacttgaaccccagaggcagaggctacagtgagccaagattgcaccactgcactccaacctgggtgatagaataagactcttgtctcaaggaaagaaaaaatgtctactcagtagagcagtgattggcaaagtgtgagaccccagaccggcaatattggcatctcctggagacttgtttaaaatgctgattactattttcaagaactttctaccttcatttttacttattttttgttttcaagggctcatggaatcagtcttccatgtgacagctttttaaatattttaagacaaaaactgagtcttctaatcttaattgtgttctagcagtagtcattgtaattatagttatttttataatttatttgtttagtgtatatctgtcactctagaatgtaggctccctgagataaaaactataattcttttgatggcagttacattcccaactcttagcacaagatctaggacatagtatgaactcaataaatttttgttgaatgaaagaaaaatgcaaatttataagccttttcagagacctactgaatcaaactctgagagtggagcccagcaatctgttgtaaaagctgtttgagtaatactgttgcactctaagcttgagaaccactgcaatagaactaagagaacattcatttcaccttcaggcctattctctgacatcacttgaaaaatcctctctgccttctgtaacccttaaccaacaacagtgccctgtccatgtaggggaaacttctgggctgtattacaagtgggtaggaaggtataaggatatcatagtgggaagtattgcttagaatgccagtacttgtttgctgtggaaggtttctaggaatggattgcttagtctaaagtaagcactaccaccatccacgttttcactcaacacagtgccttttaattggtgactaacatcaaaacaccttgacaaaccgttaaaacagtatcagaaaccatgtgtacatccctgtgcctcttagattgctaagttctgctctcattcttacttcaaaggacactttttaaagaattgttaatgcttttttataatacaagtcatagccctgttggcaaaaagaaaaaagattcagtgagaaagaaaaatcactgataattccatcatccagggagaaccactgttatttaagtatatggccttccagacttttctgtgcatttatagatatttttaatgggatcaaagtgtacatactgttttgtaactttttttcactcaacaataccatgactgtcttgctgtgtcaagtatatttctacatctcttaatggctgcatgatattccatcatatgtgccacattttattaaactactgttcaatttttaggtttccaactttcattaataaagtgctttaaagaacattgtgttgctaaatctc

SEQ ID NO: 335829 - DNA, 5908 bp, Homo sapiens
tccctgaacgctgcctgctgaggtaaccagtggagacagaggctggagactccagggtttgggagcagtggagtaagcgagggagcagtcttggaggacatacaacaggattcaagatatagagaattaaataggagcaagaatggaggggttggggagagttacagacacagatgaatgagaggggagagaggaacagcaggcaaggaagctcttgctttaggggctgtcttctgtgaagtagacagtgagctcagtcatttgtggaggacaaagatggaggcatgggtggggaaaaaaaaagggatcaaaacaattgctaaagaaaggaaactattgcaaaataagagactggatttggatgctgcaaaaacgagactaaaaaaggcaaaagctgcagaaactagaaattcatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttctgccaataaagttgcatggtaaatatttcattacagaatttatgttagagctttcatgccaagaatgttttcttacaaaattctctttttattgaggtttcactaataagcagcttctacttttgagcctcaacttaaagcagaactgttttctactggatttttcattaacagcaagctttttcttttatgtaaaataaatctattgtgaattgatatcagcgactcatttattaggtataaataatagccaaagaataaaattaaaatttattttaaactttcggtcttaaaaagagctgtaggatataaacctcttttgtgaaaagtagaattttctgaatgctttcatagacaaaaacgcatttaaactatgtttacctggttttccaacagaaatcaaatgattttaatattatgttttgatgggttattttcagagttgtttggttttttaaacactactgaatggtttcttttaaatttaagaacaactagttcttgaaaagcaataccgtatttctctgataaatttgtagttaaggttctagaaaatctaggacaaatttacttcattaaacataaagtttttaagattattcagttggcacaatttaatgcataattgggattggatccatttactgtactgtggtacagtaaagagaatgtgttcttattgaacagcagatttgtatacaaatacggaataatgcaactacattataaattgtatacgaacaaaataaattgggtcactctgagcttactattaaaacattgaaaatttattaatgaacacaggctatcttgatgaggatctctgcttatgaaacacatactaatgaaattattagtgacacattggaagctagaaaattgctgttggggccattgctataaatcattgtttccatgttaagacttctgttctaattcattcattcaacaaacatttgttgagggccagatactgtgctggtcaactggggatactgtcctgaacaatatgcacacagttcttgcccctgcagagcttaaagaccattaaaggatacagaaaattaagcaattatcctatagtaggattcgtggtgtgatggggaaaatacaaggtactgtatttgggagtcatgtaactccagttttgggagtgagagagggtctggggaagaactgttccagataaaaagatgtgtaaccaagatagcatagcacattctgacaactaaagcaatttactctaacttaagcatgaagtacaaaagtatagttcatttattgagggaatgttaagctattaaaatgatactttttggtacttttaaaaaaatgaatacttaaacaccgttttaaaattttgtgttaagagctcctaataagaacttggtaaacatgttgacaatttaactcacagtctaaactttaaaagtagtagttacccttttatttctgtgccatgagacaaattcttctgcagttttatagttgtacaagatgttttgactcactctcaattgccatattcttaaagaaaccctgaaaagctgctcaagctggtcagttttctgtaaaaccaagtaaatgaaattttctctcccctcagaaaggaagttctacagcctagagtaccatctattgtgttttataagtccagatttaggctttgaaagatcataccaaaacttcagatcgacttaaacagcaactatgaattaggtttatgggaaatgtagtaatacaggggaaagaatatcggtaatggagtgaaatggtcctgggttcaaatccagtcttcctcacatattgtgctctttaagcttcaaatgagatgtataactgccttttccttaccagtaaaatgaggacaataattatgacaccatagggtggttgtgaggattagcaaatgttatcttgtatttcaggtgcctttcagggaaaggcttggcacatagtaaacacatcctgtaaatatcagtttccccttgttagcccctgtagcatcctgacctaccaagtctataggccttgcatatcactgtgcaccagagatacctcttttacatctgggctctgttttctctctatcaatcctatcctccaccctctttaaatcagaccccaggtttaaccttcccacagtcagtataaatcatttttcagaactttcagctttccatcaagtgaaagttgattttagttacccagtaatgtacagaaaccttcaataatgttaagcttcaaaggcttctggtacgtttgtctaccacagaaccaccacaatatatatgcttgttcttaggtttattgctttttattttaatggggtttggttgtttgggttttattttggttttggcttattttaaagtcaagtttagtttttactcaggtaaaggcctgaagtttcttgggcgtggaagaaaaagcttgggaagcctattaattcatggtgcagttcagaattgtttaaataagctctgtgccactgagcttaatctgaaagtatagtgacatgtgaaggatgcacatatgaatgaaaaactaaaataattgtaggctcttctataaatgaaaaaaaaagtgattggattgtgtctacctttttcctcaaagtaatctaacctaaacggtcatggtgttaaaactttttatggtgctaatcagaaaaattgatgttgcaagaaatgaggtctcaaaaatgggaatgtgcctcctcactctgcgtcacatgggaaataaatcctgaggccaggatcaccagtggggtagagtcatcttcatagtctcctgttatcctccccctgaacaaagaacaaagtgagactgggaagctagtgttggggaaacatttctgggataaactgtggagtggagaagacaatggagggcaaggcaaaaacccacagacttgtttacccatagaggccccactcacctccatgctgacagaattccagaaaaattccttccctatctcccaaacacctgaaattctgaaatattgccctactatttagcactttaagcttcagtgaggtgctgtaatggagagatagcttcatagtttagcctatagccaactttgcctcaagacctccagataagatgaagtggcttttacctcatgtgagtctcaaacgctggagagagagttccacaaccacccctgccctttctcccatattacgctcattagaaagtctactcagggctgggtgccgtggctcatgcctgtaatcccagcactttggaggctgaggcgggtggatcatctgaggtcaggagttcgagaccagcctggccaacatggggaaaccctgtctctactgaaaatataaaaattagccgggcatggtggcgtgcacctgtaattccagctactcgggaggctgaggcaggagaatcacttgaaccccagaggcagaggctacagtgagccaagattgcaccactgcactccaacctgggtgatagaataagactcttgtctcaaggaaagaaaaaatgtctactcagtagagcagtgattggcaaagtgtgagaccccagaccggcaatattggcatctcctggagacttgtttaaaatgctgattactattttcaagaactttctaccttcatttttacttattttttgttttcaagggctcatggaatcagtcttccatgtgacagctttttaaatattttaagacaaaaactgagtcttctaatcttaattgtgttctagcagtagtcattgtaattatagttatttttataatttatttgtttagtgtatatctgtcactctagaatgtaggctccctgagataaaaactataattcttttgatggcagttacattcccaactcttagcacaagatctaggacatagtatgaactcaataaatttttgttgaatgaaagaaaaatgcaaatttataagccttttcagagacctactgaatcaaactctgagagtggagcccagcaatctgttgtaaaagctgtttgagtaatactgttgcactctaagcttgagaaccactgcaatagaactaagagaacattcatttcaccttcaggcctattctctgacatcacttgaaaaatcctctctgccttctgtaacccttaaccaacaacagtgccctgtccatgtaggggaaacttctgggctgtattacaagtgggtaggaaggtataaggatatcatagtgggaagtattgcttagaatgccagtacttgtttgctgtggaaggtttctaggaatggattgcttagtctaaagtaagcactaccaccatccacgttttcactcaacacagtgccttttaattggtgactaacatcaaaacaccttgacaaaccgttaaaacagtatcagaaaccatgtgtacatccctgtgcctcttagattgctaagttctgctctcattcttacttcaaaggacactttttaaagaattgttaatgcttttttataatacaagtcatagccctgttggcaaaaagaaaaaagattcagtgagaaagaaaaatcactgataattccatcatccagggagaaccactgttatttaagtatatggccttccagacttttctgtgcatttatagatatttttaatgggatcaaagtgtacatactgttttgtaactttttttcactcaacaataccatgactgtcttgctgtgtcaagtatatttctacatctcttaatggctgcatgatattccatcatatgtgccacattttattaaactactgttcaatttttaggtttccaactttcattaataaagtgctttaaagaacattgtgttgctaaatctc

SEQ ID NO: 335830 - DNA, 3860 bp, Homo sapiens
cgcttgtttttcccttgggacccgggtccacacggcggggtcgcccgtccatctccggctcgcccgcggggcccatcgtcgacgttagcggccgttctccgagccgactgacccatccttggcgctgccgccgcgcgcttgttctcctccctcgccccgccttcatcctccccgttcacggaaacgacagctgcggctgcggggctggcgccgcctccctccacctaccacgtctgccctcgccgctctagccctgcgccccagcccggccgcggcacctccgcctcgccgccgctaggtcggccggctccgcccggctgccgcctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcatctgaacaggaattaagaataactcaaagtgaatttgatcgtcaagcagagattaccagacttctgctagagggaatcagcagtacacatgcccatcaccttcgctgtctgaatgactttgtagaacccctgtagcatcctgacctaccaagtctataggccttgcatatcactgtgcaccagagatacctcttttacatctgggctctgttttctctctatcaatcctatcctccaccctctttaaatcagaccccaggtttaaccttcccacagtcagtataaatcatttttcagaactttcagctttccatcaagtgaaagttgattttagttacccagtaatgtacagaaaccttcaataatgttaagcttcaaaggcttctggtacgtttgtctaccacagaaccaccacaatatatatgcttgttcttaggtttattgctttttattttaatggggtttggttgtttgggttttattttggttttggcttattttaaagtcaagtttagtttttactcaggtaaaggcctgaagtttcttgggcgtggaagaaaaagcttgggaagcctattaattcatggtgcagttcagaattgtttaaataagctctgtgccactgagcttaatctgaaagtatagtgacatgtgaaggatgcacatatgaatgaaaaactaaaataattgtaggctcttctataaatgaaaaaaaaagtgattggattgtgtctacctttttcctcaaagtaatctaacctaaacggtcatggtgttaaaactttttatggtgctaatcagaaaaattgatgttgcaagaaatgaggtctcaaaaatgggaatgtgcctcctcactctgcgtcacatgggaaataaatcctgaggccaggatcaccagtggggtagagtcatcttcatagtctcctgttatcctccccctgaacaaagaacaaagtgagactgggaagctagtgttggggaaacatttctgggataaactgtggagtggagaagacaatggagggcaaggcaaaaacccacagacttgtttacccatagaggccccactcacctccatgctgacagaattccagaaaaattccttccctatctcccaaacacctgaaattctgaaatattgccctactatttagcactttaagcttcagtgaggtgctgtaatggagagatagcttcatagtttagcctatagccaactttgcctcaagacctccagataagatgaagtggcttttacctcatgtgagtctcaaacgctggagagagagttccacaaccacccctgccctttctcccatattacgctcattagaaagtctactcagggctgggtgccgtggctcatgcctgtaatcccagcactttggaggctgaggcgggtggatcatctgaggtcaggagttcgagaccagcctggccaacatggggaaaccctgtctctactgaaaatataaaaattagccgggcatggtggcgtgcacctgtaattccagctactcgggaggctgaggcaggagaatcacttgaaccccagaggcagaggctacagtgagccaagattgcaccactgcactccaacctgggtgatagaataagactcttgtctcaaggaaagaaaaaatgtctactcagtagagcagtgattggcaaagtgtgagaccccagaccggcaatattggcatctcctggagacttgtttaaaatgctgattactattttcaagaactttctaccttcatttttacttattttttgttttcaagggctcatggaatcagtcttccatgtgacagctttttaaatattttaagacaaaaactgagtcttctaatcttaattgtgttctagcagtagtcattgtaattatagttatttttataatttatttgtttagtgtatatctgtcactctagaatgtaggctccctgagataaaaactataattcttttgatggcagttacattcccaactcttagcacaagatctaggacatagtatgaactcaataaatttttgttgaatgaaagaaaaatgcaaatttataagccttttcagagacctactgaatcaaactctgagagtggagcccagcaatctgttgtaaaagctgtttgagtaatactgttgcactctaagcttgagaaccactgcaatagaactaagagaacattcatttcaccttcaggcctattctctgacatcacttgaaaaatcctctctgccttctgtaacccttaaccaacaacagtgccctgtccatgtaggggaaacttctgggctgtattacaagtgggtaggaaggtataaggatatcatagtgggaagtattgcttagaatgccagtacttgtttgctgtggaaggtttctaggaatggattgcttagtctaaagtaagcactaccaccatccacgttttcactcaacacagtgccttttaattggtgactaacatcaaaacaccttgacaaaccgttaaaacagtatcagaaaccatgtgtacatccctgtgcctcttagattgctaagttctgctctcattcttacttcaaaggacactttttaaagaattgttaatgcttttttataatacaagtcatagccctgttggcaaaaagaaaaaagattcagtgagaaagaaaaatcactgataattccatcatccagggagaaccactgttatttaagtatatggccttccagacttttctgtgcatttatagatatttttaatgggatcaaagtgtacatactgttttgtaactttttttcactcaacaataccatgactgtcttgctgtgtcaagtatatttctacatctcttaatggctgcatgatattccatcatatgtgccacattttattaaactactgttcaatttttaggtttccaactttcattaataaagtgctttaaagaacattgtgttgctaaatctc

SEQ ID NO: 335831 - DNA, 1131 bp, Homo sapiens
cgcttgtttttcccttgggacccgggtccacacggcggggtcgcccgtccatctccggctcgcccgcggggcccatcgtcgacgttagcggccgttctccgagccgactgacccatccttggcgctgccgccgcgcgcttgttctcctccctcgccccgccttcatcctccccgttcacggaaacgacagctgcggctgcggggctggcgccgcctccctccacctaccacgtctgccctcgccgctctagccctgcgccccagcccggccgcggcacctccgcctcgccgccgctaggtcggccggctccgcccggctgccgcctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaaggtgatcactgtgtcaggtgtggcactggtcagacgctaagg

SEQ ID NO: 335832 - DNA, 102 bp, Homo sapiens
caccacaaaggtagagattcttgtctgctttgttcactgctgtagctctagaacctaaaacagtgcccaggatatattaagaacttaaaaagtatttgcaaa

SEQ ID NO: 335833 - DNA, 177 bp, Homo sapiens
aagataggcagggatatgatggcatgggtgatgaaagtacaagtttagaaattattttctctggattttttttttaccttagagattccctaaggttaagtacaaagccagtctgattttcattcaattttactgatttcttgaataagtattataagaaagatgctaggaagggag

SEQ ID NO: 335834 - DNA, 449 bp, Homo sapiens
tctattcaagtaaattaatctggatacgggagaaaaaaagaaattgagaattttgtttaaatgtattgttcagagcagaatgcccaaggttttatttgaatctatgcatactgatagcaactaaaagtcattaccacccaattgcttcctggaagctgactaattctgagtgcacaagtctacacaggaaggtgagccagcatactcattctcttctgtcaggcaatcacccagtatatactgaccaaaaacatgtcctttaaaaaattaaaaccatgaacgagacagtatcataatatctgaactgtggtttctcatattttctaacctcttaataaaataaagggttcagcaaataagtctgagttcatcagatttgtttcaaccattcagcaatcatgttaaacttgagatgcattaaggagatcaagtaagggttaagaggctga

SEQ ID NO: 335835 - DNA, 189 bp, Homo sapiens
attgttacatctaaaactttagtagtgctgttttcattttattttagaacttgagtttcaggggtgggaaaaagtattctgggtttaggcctcctcagccttttattcctgtcctggagtgagagagaaccgggacttctgtatttgaatgcacagtgtcagagataaggattcccctgtgatggatta

SEQ ID NO: 335836 - DNA, 551 bp, Homo sapiens
tttgaggaagcgtttctttaaggctctgtgctatcctgaaaagactagatcatggtaggttgtcttattatgtaaataattatatcataagagagaaaaagacttgatatttaacatctaaagcacattatttaaacaagtttgtgtagtagggttctgaaatattcattttatgtgatgtgttcatatttttacaggaattgtttaaaatttttatgatgggctttgttcttttaatcgctatgcttatttaaaatattgtacataatatgaccaaaacttattgaatataaatctgtacctttcttggggtgcagagttgcatgctgctgctagtatatttagtgtcttaattaagagtcaagagccactcccaggcactcttttgtatgtgaagattcgactttttttttttttttttggagacaggttcttggtctgtcacccaggctggagtgcagtggcgcaatactggcccactgcaacctccaccttgcaggttcaagcaattctcccacctcagcctccctggtagctgggactacaggcat

SEQ ID NO: 335837 - DNA, 337 bp, Homo sapiens
atccaaataagtaatggctttactgtggcatagaaagactagagtaggccggcagctttttctgaggaatttctgcttccctttgaaacaagaccttcatttccaataaataaatcactattaggtcttgtgtacatttaatttttatgcatttcataaataaacctcctgcataattactaactccatttctaactggaaattttaaatgtttgtatcagtgaggtttaatttttcctaaggcaattataaacatggctttttgcatgacctaagtaactggcttaaattgtcataactggtattagaaatgaatccatcttttttatactctaat

SEQ ID NO: 335838 - DNA, 833 bp, Homo sapiens
atagttaacagtaaagcatttctctctttccctagacaggaccatggggtctgagttagtgtgaaagaatgcaaggatgtggaaatttgaacctcagggttgttcttactgctgctgtgtttcccggaaaacagccattgacttttcttctttctttttaacatggggaaggcatttatagcataatggagtattgtttgattatttatatgcatttccttgggtctttttgcttttagagttttgttgatttgttctttgctgtgtattgtggggaatagggtatgtgtatttgctgtgtattgtgtggggaatagggtatgaagcctatagggaagaagggtggatggagaggcactaaaagtacagggatttgacttattttaacaagaaaaaattctgatgactaaagataatttgtgaacatgtagttatggcttcataccttttgtcttagttcaggctggtataacaaattagtgtagatgaagtggcttgaacaacaaactttgatttctcacggttctggaggttgtaagttcaagatcagggtgccacccagtatggttgggctctggtgagtggcttattctgggttgtgtgctgctgatttcttgtatcctcacatggcagaaagagaactaggaagctccccggggtctctttttataagggcactaatcccattcatgaagactctgctgtcatgacctgtttcctcccaaaggccccaccttttaataccatcaagttgggggctaggatttcaacacatgaatttgacagtgggacacaaaaattcagtccatgcatcccttcaaataatatgagct

SEQ ID NO: 335839 - DNA, 159 bp, Homo sapiens
tcagtgaaataaataaatttctcagcctacaataaactcagcataaaggggggcaggcagtctttccaatgggccggcttagcagtcccctggtggtccagcagctgggattcaaatgggcctacttccatggaaaatagcgtggaaataaaccagtgg

SEQ ID NO: 335840 - DNA, 275 bp, Homo sapiens
tggccagcaaatgatggcccttggttcaaacccggcttacacctgcttttgtaaataaagttttattagcgtgcaaccaggcccactctgttatgcattgctcaggggtgcttttacactgcaaaaggcagagttgagtggttgccacagagactgaagttgttagttaccatctagccctttagagaaacagctgggtggcccctgccctgtaacacgaataaatgcagcgtttagcagagcggtggctgccttcccactggcgctgcaggttc

SEQ ID NO: 335841 - DNA, 124 bp, Homo sapiens
ggagacatgttcacttaccagtagaagctaagatgttctttgctagtcccctgcagtgtttcatataaggtttttttttttggtattatagaaaatattatacttcagtttttgaggaaaaaag

SEQ ID NO: 335842 - DNA, 550 bp, Homo sapiens
caattctcctgcctcagcttcccgagtagctgggattacaggcatcctcaaccacgcccagctaatttttgtatttttaatagagacagggtttcaccatgttggtcaggctggtgtcgaactcctgacctcaggtgatccacccacctcggcctcccaaagtgctggattacaggtgtgagccaccgcgcccggcctcatttaacaagtatttatttggccccactctgtgctggatatagtgctgaatgctgagaacacaaaagcaaacaaaaccaacaaggtccagtcctcagaactttccaactagtgattgacactgagacaaagacaggcagatagaaggcagtgtaatcacaagctcttttccaggaaagcacagggcacagcactgtggaccgtgtaaccgggaccccacacagtcagagagtgtcaaggagaggcttctagggagtgagtaactcaggaactgagatctgaaggctgcttaggagtaagccccatgaaatgagaagggaagtagaggctaaacaggcagaggaaaggttcc

SEQ ID NO: 335843 - DNA, 273 bp, Homo sapiens
tccctcaagggccatacccactccactgagaaccactgctttccctgcattgctgggtagtgagtgattaaagtgccattgcaggcgtgggtgccgagatagcagggcaccggacatgtctaagccagccatcaggaatgcacttccgttgcttgctgtaggatggtagaggtcgagttagaaatcagaaaggttggtgctttgtgtgtgggggtgaagggccacaagggaactttgaggggtggcagaaatggtctacatcctgaagtattc

SEQ ID NO: 335844 - DNA, 423 bp, Homo sapiens
cctggcttaggacgccgtggaatcgccttttctggagatgcttaagaaaagttctgcctgaaggaaaggaaaaggagtggtttatagaactgcccactaattgatcacaactccgtcctgataaacatggccatggtcttggaatatttctcaacacagccctctaagaagttactaccagtcatttggagttggaatgccagttgcacctgtttaactccctgactgtggtctagagacctcatgtcagaactgggggctgctgttctgcttgaagccagcccagaaagggaggcattagcctctcttggtcattcttcacgctttgtgtgtggctccattttccaggccatatctcttttccctttaccctgccccattccttctctgctgttgagctgccttgtggctgagttctcgtct

SEQ ID NO: 335845 - DNA, 322 bp, Homo sapiens
caggcaatgtagctgttttcaccattagccctaattttgctagatggggtgaaggtacaaccgtacaacccattcccgtcatgccttaggaattttgatacaagacttagaaacatagttgcagggttttttgttttgttttgttttttttttttttgcttagaaatcatccctgctgttccagtacttgttgttgcaggcctggtcctggaccactgcatcaggtagaggagaaaaaataaattaaaaaaaaaatttttttgaggcgatttggggaagaaagaaaaaaaatatagtcattttaccagtgtattcctccttt

SEQ ID NO: 335846 - DNA, 3265 bp, Homo sapiens
  misc_feature (332)..(332): n is a, c, g, or t
ggctcagcctcaggtcctgcggggctgaccagtgtgcagagtgccctgaaagcgccaggcctggctgggtgcttcccatcttcacagcacctgagaggcagctaccaccacccttcttatagaagaggaagcagaggctttgtgaagtgtcccaccgaggaggccctgatcttgagcccggagccctgagccctgagacgatgcttgaggatcttatgaccatgacctggctaccttgagtctgtggggctacacagccttcagcctgcatctccagggctctgactctatccagctcctggaccagctcccaagtctactcctgaccccancctgggccaaggggacttctcaagctttgggacccagcaggacacagcagcagtcagggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctgaagctcatcccgctaggcgtcttcactggcctcagcaacctgaccaagctggacatcagcgagaacaagatcgttatcctactggactacatgtttcaggacctgtacaacctcaagtcactggaggttggcgacaatgacctcgtctacatctctcaccgcgccttcagcggcctcaacagcctggagcagctgacgctggagaaatgcaacctgacctccatccccaccgaggcgctgtcccacctgcacggcctcatcgtcctgaggctccggcacctcaacatcaatgccatccgggactactccttcaagaggctgtaccgactcaaggtcttggagatctcccactggccctacttggacaccatgacacccaactgcctctacggcctcaacctgacgtccctgtccatcacacactgcaatctgaccgctgtgccctacctggccgtccgccacctagtctatctccgcttcctcaacctctcctacaaccccatcagcaccattgagggctccatgttgcatgagctgctccggctgcaggagatccagctggtgggcgggcagctggccgtggtggagccctatgccttccgcggcctcaactacctgcgcgtgctcaatgtctctggcaaccagctgaccacactggaggaatcagtcttccactcggtgggcaacctggagacactcatcctggactccaacccgctggcctgcgactgtcggctcctgtgggtgttccggcgccgctggcggctcaacttcaaccggcagcagcccacgtgcgccacgcccgagtttgtccagggcaaggagttcaaggacttccctgatgtgctactgcccaactacttcacctgccgccgcgcccgcatccgggaccgcaaggcccagcaggtgtttgtggacgagggccacacggtgcagtttgtgtgccgggccgatggcgacccgccgcccgccatcctctggctctcaccccgaaagcacctggtctcagccaagagcaatgggcggctcacagtcttccctgatggcacgctggaggtgcgctacgcccaggtacaggacaacggcacgtacctgtgcatcgcggccaacgcgggcggcaacgactccatgcccgcccacctgcatgtgcgcagctactcgcccgactggccccatcagcccaacaagaccttcgctttcatctccaaccagccgggcgagggagaggccaacagcacccgcgccactgtgcctttccccttcgacatcaagaccctcatcatcgccaccaccatgggcttcatctctttcctgggcgtcgtcctcttctgcctggtgctgctgtttctctggagccggggcaagggcaacacaaagcacaacatcgagatcgagtatgtgccccgaaagtcggacgcaggcatcagctccgccgacgcgccccgcaagttcaacatgaagatgatatgaggccggggcggggggcagggacccccgggcggccgggcaggggaaggggcctggccgccacctgctcactctccagtccttcccacctcctccctacccttctacacacgttctctttctccctcccgcctccgtcccctgctgccccccgccagccctcaccacctgccctccttctaccaggacctcagaagcccagacctggggaccccacctacacaggggcattgacagactggagttgaaagccgacgaaccgacacgcggcagagtcaataattcaataaaaaagttacgaactttctctgtaacttgggtttcaataattatggatttttatgaaaacttgaaataataaaaagagaaaaaaactatttcctatagctagtcggaatgcaaacttttgacgtcctgattgctccagggccctcttccaactcagtttcttgtttttctcttcctcctcctcctcttcttcctcctttctcttctcttccccagtggggagggatcactcaggaaaacaggaaaggaggttccagccccacccacctgcccaccccgccccaggcaccatcaggagcaggctagggggcaggcctgggcccagctccgggctggctttttgcagggcgcaggtggaggggacaggtctgccgatgggggtgggagcctgtctgctgggctgccaggcggcaccactgcaaggggtgggagcctggcttgggtgtggctgagactctggacagaggctggggtcctcctgggggacagcacagtcagtggagagagccaggggctggaggtggggcccaccccagcctctggtcccagctctgctgctcacttgctgtgtggcctcaagcaggtcactggcctctctgggcctcagtctccacatctgtacaaatgggaacattaccccctgccctgcctacctcacagggctgttgtgaggaattgatgagatgatgtatgtgaaacactttgtaacctgtaaagcgctgtgcacacgtgt

SEQ ID NO: 335847 - DNA, 3311 bp, Homo sapiens
  misc_feature (292)..(292): n is a, c, g, or t
agcggattatacagagatatttagcctaatagaagccgacagatcattcagggcagtaatgtactccggcttcaagcgtgtagtttcctcagcctgaactcccagattaaaggctccttgcccagcccgccctgtgccggtgcctgtgaccttgactgcaatgatgggggatcttatgaccatgacctggctaccttgagtctgtggggctacacagccttcagcctgcatctccagggctctgactctatccagctcctggaccagctcccaagtctactcctgaccccancctgggccaaggggacttctcaagctttgggacccagcaggacacagcagcagtcaggtgcatgctgggaccgcgacggacaggctggcggaccccaggcccccagaggccagtctgtttgcctcccaacgccatctgacccaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctgaagctcatcccgctaggcgtcttcactggcctcagcaacctgaccaagctggacatcagcgagaacaagatcgttatcctactggactacatgtttcaggacctgtacaacctcaagtcactggaggttggcgacaatgacctcgtctacatctctcaccgcgccttcagcggcctcaacagcctggagcagctgacgctggagaaatgcaacctgacctccatccccaccgaggcgctgtcccacctgcacggcctcatcgtcctgaggctccggcacctcaacatcaatgccatccgggactactccttcaagaggctgtaccgactcaaggtcttggagatctcccactggccctacttggacaccatgacacccaactgcctctacggcctcaacctgacgtccctgtccatcacacactgcaatctgaccgctgtgccctacctggccgtccgccacctagtctatctccgcttcctcaacctctcctacaaccccatcagcaccattgagggctccatgttgcatgagctgctccggctgcaggagatccagctggtgggcgggcagctggccgtggtggagccctatgccttccgcggcctcaactacctgcgcgtgctcaatgtctctggcaaccagctgaccacactggaggaatcagtcttccactcggtgggcaacctggagacactcatcctggactccaacccgctggcctgcgactgtcggctcctgtgggtgttccggcgccgctggcggctcaacttcaaccggcagcagcccacgtgcgccacgcccgagtttgtccagggcaaggagttcaaggacttccctgatgtgctactgcccaactacttcacctgccgccgcgcccgcatccgggaccgcaaggcccagcaggtgtttgtggacgagggccacacggtgcagtttgtgtgccgggccgatggcgacccgccgcccgccatcctctggctctcaccccgaaagcacctggtctcagccaagagcaatgggcggctcacagtcttccctgatggcacgctggaggtgcgctacgcccaggtacaggacaacggcacgtacctgtgcatcgcggccaacgcgggcggcaacgactccatgcccgcccacctgcatgtgcgcagctactcgcccgactggccccatcagcccaacaagaccttcgctttcatctccaaccagccgggcgagggagaggccaacagcacccgcgccactgtgcctttccccttcgacatcaagaccctcatcatcgccaccaccatgggcttcatctctttcctgggcgtcgtcctcttctgcctggtgctgctgtttctctggagccggggcaagggcaacacaaagcacaacatcgagatcgagtatgtgccccgaaagtcggacgcaggcatcagctccgccgacgcgccccgcaagttcaacatgaagatgatatgaggccggggcggggggcagggacccccgggcggccgggcaggggaaggggcctggccgccacctgctcactctccagtccttcccacctcctccctacccttctacacacgttctctttctccctcccgcctccgtcccctgctgccccccgccagccctcaccacctgccctccttctaccaggacctcagaagcccagacctggggaccccacctacacaggggcattgacagactggagttgaaagccgacgaaccgacacgcggcagagtcaataattcaataaaaaagttacgaactttctctgtaacttgggtttcaataattatggatttttatgaaaacttgaaataataaaaagagaaaaaaactatttcctatagctagtcggaatgcaaacttttgacgtcctgattgctccagggccctcttccaactcagtttcttgtttttctcttcctcctcctcctcttcttcctcctttctcttctcttccccagtggggagggatcactcaggaaaacaggaaaggaggttccagccccacccacctgcccaccccgccccaggcaccatcaggagcaggctagggggcaggcctgggcccagctccgggctggctttttgcagggcgcaggtggaggggacaggtctgccgatgggggtgggagcctgtctgctgggctgccaggcggcaccactgcaaggggtgggagcctggcttgggtgtggctgagactctggacagaggctggggtcctcctgggggacagcacagtcagtggagagagccaggggctggaggtggggcccaccccagcctctggtcccagctctgctgctcacttgctgtgtggcctcaagcaggtcactggcctctctgggcctcagtctccacatctgtacaaatgggaacattaccccctgccctgcctacctcacagggctgttgtgaggaattgatgagatgatgtatgtgaaacactttgtaacctgtaaagcgctgtgcacacgtgt

SEQ ID NO: 335848 - DNA, 2959 bp, Homo sapiens
ccaggctggtacgccccggaagtatgggatcccgagccccggccccggctccggctcggctcccgcccgcgcggggcggacagacggacagccagccccgcgagggcgcgcggactgccgggcggaggtgtcggaggaggaggaaacggaggagggggctgggcaggggctggggcctggtcgggccggctggagagacatgcgattggtgaccgagccgagcggaccgaaggcgcgcccgagatgcaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctgaagctcatcccgctaggcgtcttcactggcctcagcaacctgaccaagctggacatcagcgagaacaagatcgttatcctactggactacatgtttcaggacctgtacaacctcaagtcactggaggttggcgacaatgacctcgtctacatctctcaccgcgccttcagcggcctcaacagcctggagcagctgacgctggagaaatgcaacctgacctccatccccaccgaggcgctgtcccacctgcacggcctcatcgtcctgaggctccggcacctcaacatcaatgccatccgggactactccttcaagaggctgtaccgactcaaggtcttggagatctcccactggccctacttggacaccatgacacccaactgcctctacggcctcaacctgacgtccctgtccatcacacactgcaatctgaccgctgtgccctacctggccgtccgccacctagtctatctccgcttcctcaacctctcctacaaccccatcagcaccattgagggctccatgttgcatgagctgctccggctgcaggagatccagctggtgggcgggcagctggccgtggtggagccctatgccttccgcggcctcaactacctgcgcgtgctcaatgtctctggcaaccagctgaccacactggaggaatcagtcttccactcggtgggcaacctggagacactcatcctggactccaacccgctggcctgcgactgtcggctcctgtgggtgttccggcgccgctggcggctcaacttcaaccggcagcagcccacgtgcgccacgcccgacatcctctggctctcaccccgaaagcacctggtctcagccaagagcaatgggcggctcacagtcttccctgatggcacgctggaggtgcgctacgcccaggtacaggacaacggcacgtacctgtgcatcgcggccaacgcgggcggcaacgactccatgcccgcccacctgcatgtgcgcagctactcgcccgactggccccatcagcccaacaagaccttcgctttcatctccaaccagccgggcgagggagaggccaacagcacccgcgccactgtgcctttccccttcgacatcaagaccctcatcatcgccaccaccatgggcttcatctctttcctgggcgtcgtcctcttctgcctggtgctgctgtttctctggagccggggcaagggcaacacaaagcacaacatcgagatcgagtatgtgccccgaaagtcggacgcaggcatcagctccgccgacgcgccccgcaagttcaacatgaagatgatatgaggccggggcggggggcagggacccccgggcggccgggcaggggaaggggcctggccgccacctgctcactctccagtccttcccacctcctccctacccttctacacacgttctctttctccctcccgcctccgtcccctgctgccccccgccagccctcaccacctgccctccttctaccaggacctcagaagcccagacctggggaccccacctacacaggggcattgacagactggagttgaaagccgacgaaccgacacgcggcagagtcaataattcaataaaaaagttacgaactttctctgtaacttgggtttcaataattatggatttttatgaaaacttgaaataataaaaagagaaaaaaactatttcctatagctagtcggaatgcaaacttttgacgtcctgattgctccagggccctcttccaactcagtttcttgtttttctcttcctcctcctcctcttcttcctcctttctcttctcttccccagtggggagggatcactcaggaaaacaggaaaggaggttccagccccacccacctgcccaccccgccccaggcaccatcaggagcaggctagggggcaggcctgggcccagctccgggctggctttttgcagggcgcaggtggaggggacaggtctgccgatgggggtgggagcctgtctgctgggctgccaggcggcaccactgcaaggggtgggagcctggcttgggtgtggctgagactctggacagaggctggggtcctcctgggggacagcacagtcagtggagagagccaggggctggaggtggggcccaccccagcctctggtcccagctctgctgctcacttgctgtgtggcctcaagcaggtcactggcctctctgggcctcagtctccacatctgtacaaatgggaacattaccccctgccctgcctacctcacagggctgttgtgaggaattgatgagatgatgtatgtgaaacactttgtaacctgtaaagcgctgtgcacacgtgt

SEQ ID NO: 335849 - DNA, 2934 bp, Homo sapiens
ccaggctggtacgccccggaagtatgggatcccgagccccggccccggctccggctcggctcccgcccgcgcggggcggacagacggacagccagccccgcgagggcgcgcggactgccgggcggaggtgtcggaggaggaggaaacggaggagggggctgggcaggggctggggcctggtcgggccggctggagagacatgcgattggtgaccgagccgagcggaccgaaggcgcgcccgagatgcaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctgaagctcatcccgctaggcgtcttcactggcctcagcaacctgaccaagctggacatcagcgagaacaagatcgttatcctactggactacatgtttcaggacctgtacaacctcaagtcactggaggttggcgacaatgacctcgtctacatctctcaccgcgccttcagcggcctcaacagcctggagcagctgacgctggagaaatgcaacctgacctccatccccaccgaggcgctgtcccacctgcacggcctcatcgtcctgaggctccggcacctcaacatcaatgccatccgggactactccttcaagaggctgtaccgactcaaggtcttggagatctcccactggccctacttggacaccatgacacccaactgcctctacggcctcaacctgacgtccctgtccatcacacactgcaatctgaccgctgtgccctacctggccgtccgccacctagtctatctccgcttcctcaacctctcctacaaccccatcagcaccattgagggctccatgttgcatgagctgctccggctgcaggagatccagctggtgggcgggcagctggccgtggtggagccctatgccttccgcggcctcaactacctgcgcgtgctcaatgtctctggcaaccagctgaccacactggaggaatcagtcttccactcggtgggcaacctggagacactcatcctggactccaacccgctggcctgcgactgtcggctcctgtgggtgttccggcgccgctggcggctcaacttcaaccggcagcagcccacgtgcgccacgcccgagtttgtccagggcaaggagttcaaggacttccctgatgtgctactgcccaactacttcacctgccgccgcgcccgcatccgggaccgcaaggcccagcaggtgtttgtggacgagggccacacggtgcagtttgtgtgccgggccgatggcgacccgccgcccgccatcctctggctctcaccccgaaagcacctggtctcagccaagagcaatgggcggctcacagtcttccctgatggcacgctggaggtgcgctacgcccaggtacaggacaacggcacgtacctgtgcatcgcggccaacgcgggcggcaacgactccatgcccgcccacctgcatgtgcgcagctactcgcccgactggccccatcagcccaacaagaccttcgctttcatctccaaccagccgggcgagggagaggccaacagcacccgcgccactgtgcctttcccttcaacatgaagatgatatgaggccggggcggggggcagggacccccgggcggccgggcaggggaaggggcctggccgccacctgctcactctccagtccttcccacctcctccctacccttctacacacgttctctttctccctcccgcctccgtcccctgctgccccccgccagccctcaccacctgccctccttctaccaggacctcagaagcccagacctggggaccccacctacacaggggcattgacagactggagttgaaagccgacgaaccgacacgcggcagagtcaataattcaataaaaaagttacgaactttctctgtaacttgggtttcaataattatggatttttatgaaaacttgaaataataaaaagagaaaaaaactatttcctatagctagtcggaatgcaaacttttgacgtcctgattgctccagggccctcttccaactcagtttcttgtttttctcttcctcctcctcctcttcttcctcctttctcttctcttccccagtggggagggatcactcaggaaaacaggaaaggaggttccagccccacccacctgcccaccccgccccaggcaccatcaggagcaggctagggggcaggcctgggcccagctccgggctggctttttgcagggcgcaggtggaggggacaggtctgccgatgggggtgggagcctgtctgctgggctgccaggcggcaccactgcaaggggtgggagcctggcttgggtgtggctgagactctggacagaggctggggtcctcctgggggacagcacagtcagtggagagagccaggggctggaggtggggcccaccccagcctctggtcccagctctgctgctcacttgctgtgtggcctcaagcaggtcactggcctctctgggcctcagtctccacatctgtacaaatgggaacattaccccctgccctgcctacctcacagggctgttgtgaggaattgatgagatgatgtatgtgaaacactttgtaacctgtaaagcgctgtgcacacgtgt

SEQ ID NO: 335850 - DNA, 248 bp, Homo sapiens
ccagcggcagaggcggcggcggcggctccgggccggcccagggggcagaagcaggctcgcgcagcccctgtcccgcggcctgagcgcgcccgcccatccgcccgccggggccgcggcctcccgcctccccactcccgagccccggccccggctccggctcggctcccgcccgcgcggggcggacagacggacagccagccccgcgagggcgcgcggactgccgggcggaggtgtcggaggaggaggaa

SEQ ID NO: 335851 - DNA, 3124 bp, Homo sapiens
ccaggctggtacgccccggaagtatgggatcccgagccccggccccggctccggctcggctcccgcccgcgcggggcggacagacggacagccagccccgcgagggcgcgcggactgccgggcggaggtgtcggaggaggaggaaacggaggagggggctgggcaggggctggggcctggtcgggccggctggagagacatgcgattggtgaccgagccgagcggaccgaaggcgcgcccgagatgcaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctgaagctcatcccgctaggcgtcttcactggcctcagcaacctgaccaagctggacatcagcgagaacaagatcgttatcctactggactacatgtttcaggacctgtacaacctcaagtcactggaggttggcgacaatgacctcgtctacatctctcaccgcgccttcagcggcctcaacagcctggagcagctgacgctggagaaatgcaacctgacctccatccccaccgaggcgctgtcccacctgcacggcctcatcgtcctgaggctccggcacctcaacatcaatgccatccgggactactccttcaagaggctgtaccgactcaaggtcttggagatctcccactggccctacttggacaccatgacacccaactgcctctacggcctcaacctgacgtccctgtccatcacacactgcaatctgaccgctgtgccctacctggccgtccgccacctagtctatctccgcttcctcaacctctcctacaaccccatcagcaccattgagggctccatgttgcatgagctgctccggctgcaggagatccagctggtgggcgggcagctggccgtggtggagccctatgccttccgcggcctcaactacctgcgcgtgctcaatgtctctggcaaccagctgaccacactggaggaatcagtcttccactcggtgggcaacctggagacactcatcctggactccaacccgctggcctgcgactgtcggctcctgtgggtgttccggcgccgctggcggctcaacttcaaccggcagcagcccacgtgcgccacgcccgagtttgtccagggcaaggagttcaaggacttccctgatgtgctactgcccaactacttcacctgccgccgcgcccgcatccgggaccgcaaggcccagcaggtgtttgtggacgagggccacacggtgcagtttgtgtgccgggccgatggcgacccgccgcccgccatcctctggctctcaccccgaaagcacctggtctcagccaagagcaatgggcggctcacagtcttccctgatggcacgctggaggtgcgctacgcccaggtacaggacaacggcacgtacctgtgcatcgcggccaacgcgggcggcaacgactccatgcccgcccacctgcatgtgcgcagctactcgcccgactggccccatcagcccaacaagaccttcgctttcatctccaaccagccgggcgagggagaggccaacagcacccgcgccactgtgcctttccccttcgacatcaagaccctcatcatcgccaccaccatgggcttcatctctttcctgggcgtcgtcctcttctgcctggtgctgctgtttctctggagccggggcaagggcaacacaaagcacaacatcgagatcgagtatgtgccccgaaagtcggacgcaggcatcagctccgccgacgcgccccgcaagttcaacatgaagatgatatgaggccggggcggggggcagggacccccgggcggccgggcaggggaaggggcctggccgccacctgctcactctccagtccttcccacctcctccctacccttctacacacgttctctttctccctcccgcctccgtcccctgctgccccccgccagccctcaccacctgccctccttctaccaggacctcagaagcccagacctggggaccccacctacacaggggcattgacagactggagttgaaagccgacgaaccgacacgcggcagagtcaataattcaataaaaaagttacgaactttctctgtaacttgggtttcaataattatggatttttatgaaaacttgaaataataaaaagagaaaaaaactatttcctatagctagtcggaatgcaaacttttgacgtcctgattgctccagggccctcttccaactcagtttcttgtttttctcttcctcctcctcctcttcttcctcctttctcttctcttccccagtggggagggatcactcaggaaaacaggaaaggaggttccagccccacccacctgcccaccccgccccaggcaccatcaggagcaggctagggggcaggcctgggcccagctccgggctggctttttgcagggcgcaggtggaggggacaggtctgccgatgggggtgggagcctgtctgctgggctgccaggcggcaccactgcaaggggtgggagcctggcttgggtgtggctgagactctggacagaggctggggtcctcctgggggacagcacagtcagtggagagagccaggggctggaggtggggcccaccccagcctctggtcccagctctgctgctcacttgctgtgtggcctcaagcaggtcactggcctctctgggcctcagtctccacatctgtacaaatgggaacattaccccctgccctgcctacctcacagggctgttgtgaggaattgatgagatgatgtatgtgaaacactttgtaacctgtaaagcgctgtgcacacgtgt

SEQ ID NO: 335852 - DNA, 2887 bp, Homo sapiens
ccaggctggtacgccccggaagtatgggatcccgagccccggccccggctccggctcggctcccgcccgcgcggggcggacagacggacagccagccccgcgagggcgcgcggactgccgggcggaggtgtcggaggaggaggaaacggaggagggggctgggcaggggctggggcctggtcgggccggctggagagacatgcgattggtgaccgagccgagcggaccgaaggcgcgcccgagatgcaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctgaagctcatcccgctaggcgtcttcactggcctcagcaacctgaccaagctggacatcagcgagaacaagatcgttatcctactggactacatgtttcaggacctgtacaacctcaagtcactggaggttggcgacaatgacctcgtctacatctctcaccgcgccttcagcggcctcaacagcctggagcagctgacgctggagaaatgcaacctgacctccatccccaccgaggcgctgtcccacctgcacggcctcatcgtcctgaggctccggcacctcaacatcaatgccatccgggactactccttcaagaggctgtaccgactcaaggtcttggagatctcccactggccctacttggacaccatgacacccaactgcctctacggcctcaacctgacgtccctgtccatcacacactgcaatctgaccgctgtgccctacctggccgtccgccacctagtctatctccgcttcctcaacctctcctacaaccccatcagcaccattgagggctccatgttgcatgagctgctccggctgcaggagatccagctggtgggcgggcagctggccgtggtggagccctatgccttccgcggcctcaactacctgcgcgtgctcaatgtctctggcaaccagctgaccacactggaggaatcagtcttccactcggtgggcaacctggagacactcatcctggactccaacccgctggcctgcgactgtcggctcctgtgggtgttccggcgccgctggcggctcaacttcaaccggcagcagcccacgtgcgccacgcccgagtttgtccagggcaaggagttcaaggacttccctgatgtgctactgcccaactacttcacctgccgccgcgcccgcatccgggaccgcaaggcccagcaggtgtttgtggacgagggccacacggtgcagtttgtgtgccgggccgatggcgacccgccgcccgccatcctctggctctcaccccgaaagcacctggtctcagccaagagcaatgggcggctcacagtcttccctgatggcacgctggaggtgcgctacgcccaggtacaggacaacggcacgtacctgtgcatcgcggccaacgcgggcggcaacgactccatgcccgcccacctgcatgtgcgcagctactcgcccgactggccccatcagcccaacaagaccttcgctttcatctccaaccagccgggcgagggagaggccaacagcacccgcgccactgtgcctttccccttcgacatcaagaccctcatcatcgccaccaccatgggcttcatctctttcctgggcgtcgtcctcttctgcctggtgctgctgtttctctggagccggggcaagggcaacacaaagcacaacatcgagatcgagtatctgccctccttctaccaggacctcagaagcccagacctggggaccccacctacacaggggcattgacagactggagttgaaagccgacgaaccgacacgcggcagagtcaataattcaataaaaaagttacgaactttctctgtaacttgggtttcaataattatggatttttatgaaaacttgaaataataaaaagagaaaaaaactatttcctatagctagtcggaatgcaaacttttgacgtcctgattgctccagggccctcttccaactcagtttcttgtttttctcttcctcctcctcctcttcttcctcctttctcttctcttccccagtggggagggatcactcaggaaaacaggaaaggaggttccagccccacccacctgcccaccccgccccaggcaccatcaggagcaggctagggggcaggcctgggcccagctccgggctggctttttgcagggcgcaggtggaggggacaggtctgccgatgggggtgggagcctgtctgctgggctgccaggcggcaccactgcaaggggtgggagcctggcttgggtgtggctgagactctggacagaggctggggtcctcctgggggacagcacagtcagtggagagagccaggggctggaggtggggcccaccccagcctctggtcccagctctgctgctcacttgctgtgtggcctcaagcaggtcactggcctctctgggcctcagtctccacatctgtacaaatgggaacattaccccctgccctgcctacctcacagggctgttgtgaggaattgatgagatgatgtatgtgaaacactttgtaacctgtaaagcgctgtgcacacgtgt

SEQ ID NO: 335853 - DNA, 556 bp, Homo sapiens
ctactcgggaggctgaggcaggagaatcacttgaactcaggaggcaggggttgcagttagccgagatcatatcgctgtacttcagcctgggagacagagtgggactccatctcaaaacagcaacaacaacaaactattactaaatgagaacttagacatcatttactcataagtttaaggtatgacatcatttacatacaaaatttagctgttaattctaaattgttaagttttaaaaattttgttgtcagctaaattgaatgtagcataattctaaacaaatcttggattaatgtcattgaccccaagcatcctctagccctggaatattagcattggcctgttagtcccctgagctactactccctgggaggtggtcatcctttcttaactcattctttccagccctggggagcctcggaacttttgtctattcacttctttacaaagctgaggaccatcgttgagctgaggaccatcgttgagctgaggaccatcgttgagctgaggaccatcgttgagctgaggagcatcgtgaggctgaggaccatcgttg

SEQ ID NO: 335854 - DNA, 317 bp, Homo sapiens
cagtattggaatggtcatttgataattatttgttctgtaaactttgattttatcactgatggagcatttcttttggctttcctaaagttattttagcacctgccacctatagcttgtttgctttccgttttttctagtcctgcccttgtgggatgaagttctctgttgtataagtctcgtccatattgagaaacagaggagtctcaaagcccctccttgtgtctggtcttggtatctcacccctctcttgtcttgactttactggttatcttcaagtggaaacaagtagagaaaaatcttgtcagctaggcatgtat

SEQ ID NO: 335855 - DNA, 202 bp, Homo sapiens
aggcactcaatctttaagattttagaataactgtgcatttgtcagggttctccagacagacagaaccagtaggacatacgagaagggatttaatcagagaaatctgctcacatgatcacaaagacagagaaatcccacaacaggccatctgcaagctagtgaatcagaggtggcagcatgcctgggtccaagtctggaagcc

SEQ ID NO: 335856 - DNA, 458 bp, Homo sapiens
ggggaggaaggtgagtaaaaatcacacccagaacagaagggaccatggcaccaagatgttgggtttcatccagacagtgatgagtaggcactgaagagttccctgagaagtgataggactaatctgtgtttcataaggatcaaattctggccacaatgaggaggatttggatggcatgggaaggcaggaagacaagggagaaaacctctatttaccccatcacatattctgcaatggtgcttaggttaaagtatgaccttgtattgttgcacaagaagatccactcacccaacagctaattagcaaagaggcctaataataataacctagatttcatttaatcctcatagccatcctgggaagctccatcttacagaagaggtaactgaggttcagaaaggttaaatgacttgtgtaaaatgtcacagtgagtgaatgacagagtgggacttgcatta

SEQ ID NO: 335857 - DNA, 207 bp, Homo sapiens
tgcacctggcctaaatatcattttaatggttaagttctgttttcttagttctactctcacggggcctttatattctatagacgcttttgtttgggcaggaagatgtgagtgttcagtcttttggacagcattaatagatattgatattgcagtattgatagtggcaactctatattgagtgctcactgagggactggccctttgctc

SEQ ID NO: 335858 - DNA, 2089 bp, Homo sapiens
gacattggcagagctagctgaggttttattttggaccaaaaaaaaaaagcaattgaattgttttgtacctggaggcatgggcaaggggggtccccaggtagtaaactccccaggtgggctgagggctagggctgagcctcaggtgggtctcctgttcccagtgctaccctgcatagcggcctccttccggggcaagagccgcgccgcaggagaggcaggctggaccgggggctccccgggcccgcgacccccgccgtgaccccgcagcccccagctcgcccccaagatgatgaagaggcagctgcaccgcatgcggcagctggcccagacgggcagcttgggacgcaccccggagaccgctgagttcctgggtgaggacctgctgcaggtagaacagcggctggagccggccaagcgggcagcccacaacatccacaagcggctgcaggcctgtctgcagggccagagcggggcagacatggacaagcgggtgaagaagcttcccctcatggctctgtccaccacgatggctgagagcttcaaggagctggaccctgattccagcatggggaaggccttggagatgagctgtgccatccagaatcagctggcccgcatcctggccgagtttgagatgaccctggagagggacgtcctgcagccactcagcaggctgagtgaggaggagctgccagccatcctcaaacacaagaaaagcctccagaagctcgtgtccgactggaacacactcaagagcaggctcagtcaggcaaccaagaattcaggcagcagtcaaggcctaggaggcagcccgggtagtcacagccatacgaccatggccaacaaggtggagacgctgaaggaggaggaggaggagctgaagaggaaagtggagcaatgcagggacgagtacttggctgacctgtaccactttgttaccaaggaggactcctatgccaactacttcattcgtctcctggagattcaggccgattaccatcgcaggtcactgagctcgctggacacagccctggctgagctgagggagaaccacggccaagcagaccactccccttcgatgacagccacccacttccccagggtgtatggggtgtcgctggcaacccacctgcaagagctgggccgggagattgccctgcccatcgaggcctgcgtcatgatgctgctttctgagggcatgaaggaagagggtctcttccgtctggctgctggggcctcggtgctgaagcgtctcaagcagacaatggcctcggacccccacagcctggaggagttctgctccgacccgcacgctgtggcaggtgccctcaagtcctatctgcgggagctgccagagcctctgatgaccttcgacctctatgatgactggatgagggcagccagcctgaaggagccaggggcccggctgcaggccctccaagaggtgtgcagccgcctaccccccgagaacctcagcaacctcaggtacctgatgaagttcctggcacggctggccgaggagcaggaggtgaacaagatgacacccagcaacatcgccatagtcctgggacccaacttgctgtggccacctgagaaagaaggggaccaggcccagctggatgcagcctccgtgtcttccatccaggtggtgggcgtcgtcgaggcgctgatccagagcgcagacaccctcttccctggagacatcaacttcaacgtgtcaggcctcttctcagctgttaccctccaggacacagtcagtgacaggctggcctctgaggaacttccgtccactgccgtgcccaccccagccaccaccccggctccggctccggctccagctccagctccggccccagccttggcttcagcagctaccaaggaaaggacagagtctgaggtgcctcccagaccagcctcccccaaggtcaccaggagtcccccggagacagctgccccagtggaggacatggctcggaggagtcctaggggagccaccggaaggaaggagaggtttgcctgctcctacgggactgattcttctcttgccgacatgttttttgtaaggctggtaaataaattattttggaca

SEQ ID NO: 335859 - DNA, 554 bp, Homo sapiens
tggccacaccaggaggatgctgtggggtctgctgagtacagtgtgtgtacttgtgcacgcctggtccctaggagcacaggtggttagcgtatctgtgagggtgtgcccgcgtgtgtcacagctggtgctggggcaaccctaaagcctgggatcctgtaaacagtcctgcggcagccctgttctcccctctgtggagtggctgtgatcaccaaatctccctaagcagccctcagcaccccctccctccccacctggccctcccaggacagctctcgccccccacaaaggggcatgggcctccagcctttgcccacaagtgcctcagtgcccactgggtcggcccccatggccaggagggctcaggacaatcctctatttcctgaccttttcctcgtccaccctgggcttggggacccccccaccggactctccactctccggcaggtcctaggggagccaccggaaggaaggagaggtttgcctgctcctacgggactgattcttctcttgccgacatgttttttgtaaggctggtaaataaattattttggaca

SEQ ID NO: 335860 - DNA, 2743 bp, Homo sapiens
gacattggcagagctagctgaggttttattttggaccaaaaaaaaaaagcaattgaattgttttgtacctggaggcatgggcaaggggggtccccaggtagtaaactccccaggtgggctgagggctagggctgagcctcaggtgggtctcctgttcccagtgctaccctgcatagcggcctccttccggggcaagagccgcgccgcaggagaggcaggctggaccgggggctccccgggcccgcgacccccgccgtgaccccgcagcccccagctcgcccccaagatgatgaagaggcagctgcaccgcatgcggcagctggcccagacgggcagcttgggacgcaccccggagaccgctgagttcctgggtgaggacctgctgcaggtagaacagcggctggagccggccaagcgggcagcccacaacatccacaagcggctgcaggcctgtctgcagggccagagcggggcagacatggacaagcgggtgaagaagcttcccctcatggctctgtccaccacgatggctgagagcttcaaggagctggaccctgattccagcatggggaaggccttggagatgagctgtgccatccagaatcagctggcccgcatcctggccgagtttgagatgaccctggagagggacgtcctgcagccactcagcaggctgagtgaggaggagctgccagccatcctcaaacacaagaaaagcctccagaagctcgtgtccgactggaacacactcaagagcaggctcagtcaggcaaccaagaattcaggcagcagtcaaggcctaggaggcagcccgggtagtcacagccatacgaccatggccaacaaggtggagacgctgaaggaggaggaggaggagctgaagaggaaagtggagcaatgcagggacgagtacttggctgacctgtaccactttgttaccaaggaggactcctatgccaactacttcattcgtctcctggagattcaggccgattaccatcgcaggtcactgagctcgctggacacagccctggctgagctgagggagaaccacggccaagcagaccactccccttcgatgacagccacccacttccccagggtgtatggggtgtcgctggcaacccacctgcaagagctgggccgggagattgccctgcccatcgaggcctgcgtcatgatgctgctttctgagggcatgaaggaagagggtctcttccgtctggctgctggggcctcggtgctgaagcgtctcaagcagacaatggcctcggacccccacagcctggaggagttctgctccgacccgcacgctgtggcaggtgccctcaagtcctatctgcgggagctgccagagcctctgatgaccttcgacctctatgatgactggatgagggcagccagcctgaaggagccaggggcccggctgcaggccctccaagaggtgtgcagccgcctaccccccgagaacctcagcaacctcaggtacctgatgaagttcctggcacggctggccgaggagcaggaggtgaacaagatgacacccagcaacatcgccatagtcctgggacccaacttgctgtggccacctgagaaagaaggggaccaggcccagctggatgcagcctccgtgtcttccatccaggtggtgggcgtcgtcgaggcgctgatccagagcgcagacaccctcttccctggagacatcaacttcaacgtgtcaggcctcttctcagctgttaccctccaggacacagtcagtgacaggctggcctctgaggaacttccgtccactgccgtgcccaccccagccaccaccccggctccggctccggctccagctccagctccggccccagccttggcttcagcagctaccaaggaaaggacagagtctgaggtgcctcccagaccagcctcccccaaggtcaccaggagtcccccggagacagctgccccagtggaggacatggctcggaggaccaagcgcccggcgccagcccggcccaccatgccgcccccccaggtctccggctcccgctcctcccctccagccccgcccttgccccctggctctggcagccctgggaccccccaagccctgccccgacgtctggttggcagcagcctccgagcccccacagtgccacccccgttaccccccacaccccctcagcctgcccggcgccaaagccggcgttcaccagcctcccccagcccggcctccccaggtccagcctcccccagcccagtctctttgagtaaccctgcacaggtggacctgggggctgccacagcagagggaggagcccctgaggctatcagtggggtccccactcccccagctatcccccctcagccccgccccaggagccttgcctcagagaccaactgagtggctggtttctccctaagcagccctcagcaccccctccctccccacctggccctcccaggacagctctcgccccccacaaaggggcatgggcctccagcctttgcccacaagtgcctcagtgcccactgggtcggcccccatggccaggagggctcaggacaatcctctatttcctgaccttttcctcgtccaccctgggcttggggacccccccaccggactctccactctccggcaggtcctaggggagccaccggaaggaaggagaggtttgcctgctcctacgggactgattcttctcttgccgacatgttttttgtaaggctggtaaataaattattttggaca

SEQ ID NO: 335861 - DNA, 2075 bp, Homo sapiens
  misc_feature (21)..(22): n is a, c, g, or t
  misc_feature (27)..(27): n is a, c, g, or t
aaacttaggctagtagaggcnngtgtnaatcggccgaggacaagaaaagcctccagaagctcgtgtccgactggaacacactcaagagcaggctcagtcaggcaaccaagaattcaggcagcagtcaaggcctaggaggcagcccgggtagtcacagccatacgaccatggccaacaaggtggagacgctgaaggaggaggaggaggagctgaagaggaaagtggagcaatgcagggacgagtacttggctgacctgtaccactttgttaccaaggaggactcctatgccaactacttcattcgtctcctggagattcaggccgattaccatcgcaggtcactgagctcgctggacacagccctggctgagctgagggagaaccacggccaagcagaccactccccttcgatgacagccacccacttccccagggtgtatggggtgtcgctggcaacccacctgcaagagctgggccgggagattgccctgcccatcgaggcctgcgtcatgatgctgctttctgagggcatgaaggaagagggtctcttccgtctggctgctggggcctcggtgctgaagcgtctcaagcagacaatggcctcggacccccacagcctggaggagttctgctccgacccgcacgctgtggcaggtgccctcaagtcctatctgcgggagctgccagagcctctgatgaccttcgacctctatgatgactggatgagggcagccagcctgaaggagccaggggcccggctgcaggccctccaagaggtgtgcagccgcctaccccccgagaacctcagcaacctcaggtacctgatgaagttcctggcacggctggccgaggagcaggaggtgaacaagatgacacccagcaacatcgccatagtcctgggacccaacttgctgtggccacctgagaaagaaggggaccaggcccagctggatgcagcctccgtgtcttccatccaggtggtgggcgtcgtcgaggcgctgatccagagcgcagacaccctcttccctggagacatcaacttcaacgtgtcaggcctcttctcagctgttaccctccaggacacagtcagtgacaggctggcctctgaggaacttccgtccactgccgtgcccaccccagccaccaccccggctccggctccggctccagctccagctccggccccagccttggcttcagcagctaccaaggaaaggacagagtctgaggtgcctcccagaccagcctcccccaaggtcaccaggagtcccccggagacagctgccccagtggaggacatggctcggaggaccaagcgcccggcgccagcccggcccaccatgccgcccccccaggtctccggctcccgctcctcccctccagccccgcccttgccccctggctctggcagccctgggaccccccaagccctgccccgacgtctggttggcagcagcctccgagcccccacagtgccacccccgttaccccccacaccccctcagcctgcccggcgccaaagccggcgttcaccagcctcccccagcccggcctccccaggtccagcctcccccagcccagtctctttgagtaaccctgcacaggtggacctgggggctgccacagcagagggaggagcccctgaggctatcagtggggtccccactcccccagctatcccccctcagccccgccccaggagccttgcctcagagaccaactgagtggctggtttctccctaagcagccctcagcaccccctccctccccacctggccctcccaggacagctctcgccccccacaaaggggcatgggcctccagcctttgcccacaagtgcctcagtgcccactgggtcggcccccatggccaggagggctcaggacaatcctctatttcctgaccttttcctcgtccaccctgggcttggggacccccccaccggactctccactctccggcaggtcctaggggagccaccggaaggaaggagaggtttgcctgctcctacgggactgattcttctcttgccgacatgttttttgtaaggctggtaaataaattattttggaca

SEQ ID NO: 335862 - DNA, 2825 bp, Homo sapiens
gacattggcagagctagctgaggttttattttggaccaaaaaaaaaaagcaattgaattgttttgtacctggaggcatgggcaaggggggtccccaggtagtaaactccccaggtgggctgagggctagggctgagcctcaggtgggtctcctgttcccagtgctaccctgcatagcggcctccttccggggcaagagccgcgccgcaggagaggcaggctggaccgggggctccccgggcccgcgacccccgccgtgaccccgcagcccccagctcgcccccaagatgatgaagaggcagctgcaccgcatgcggcagctggcccagacgggcagcttgggacgcaccccggagaccgctgagttcctgggtgaggacctgctgcaggtagaacagcggctggagccggccaagcgggcagcccacaacatccacaagcggctgcaggcctgtctgcagggccagagcggggcagacatggacaagcgggtgaagaagcttcccctcatggctctgtccaccacgatggctgagagcttcaaggagctggaccctgattccagcatggggaaggccttggagatgagctgtgccatccagaatcagctggcccgcatcctggccgagtttgagatgaccctggagagggacgtcctgcagccactcagcaggctgagtgaggaggagctgccagccatcctcaaacacaagaaaagcctccagaagctcgtgtccgactggaacacactcaagagcaggctcagtcaggcaaccaagaattcaggcagcagtcaaggcctaggaggcagcccgggtagtcacagccatacgaccatggccaacaaggtggagacgctgaaggaggaggaggaggagctgaagaggaaagtggagcaatgcagggacgagtacttggctgacctgtaccactttgttaccaaggaggactcctatgccaactacttcattcgtctcctggagattcaggccgattaccatcgcaggtcactgagctcgctggacacagccctggctgagctgagggagaaccacggccaagcagaccactccccttcgatgacagccacccacttccccagggtgtatggggtgtcgctggcaacccacctgcaagagctgggccgggagattgccctgcccatcgaggcctgcgtcatgatgctgctttctgagggcatgaaggaagagggtctcttccgtctggctgctggggcctcggtgctgaagcgtctcaagcagacaatggcctcggacccccacagcctggaggagttctgctccgacccgcacgctgtggcaggtgccctcaagtcctatctgcgggagctgccagagcctctgatgaccttcgacctctatgatgactggatgagggcagccagcctgaaggagccaggggcccggctgcaggccctccaagaggtgtgcagccgcctaccccccgagaacctcagcaacctcaggtacctgatgaagttcctggcacggctggccgaggagcaggaggtgaacaagatgacacccagcaacatcgccatagtcctgggacccaacttgctgtggccacctgagaaagaaggggaccaggcccagctggatgcagcctccgtgtcttccatccaggtggtgggcgtcgtcgaggcgctgatccagagcgcagacaccctcttccctggagacatcaacttcaacgtgtcaggcctcttctcagctgttaccctccaggacacagtcagtgacaggctggcctctgaggaacttccgtccactgccgtgcccaccccagccaccaccccggctccggctccggctccagctccagctccggccccagccttggcttcagcagctaccaaggaaaggacagagtctgaggtgcctcccagaccagcctcccccaaggtcaccaggagtcccccggagacagctgccccagtggaggacatggctcggaggaccaagcgcccggcgccagcccggcccaccatgccgcccccccaggtctccggctcccgctcctcccctccagccccgcccttgccccctggctctggcagccctgggaccccccaagccctgccccgacgtctggttggcagcagcctccgagcccccacagtgccacccccgttaccccccacaccccctcagcctgcccggcgccaaagccggcgttcaccagcctcccccagcccggcctccccaggtccagcctcccccagcccagtctctttgagtaaccctgcacaggtggacctgggggctgccacagcagagggaggagcccctgaggctatcagtggggtccccactcccccagctatcccccctcagccccgccccaggagccttgcctcagagaccaactgagtggctggtttctccctaagcagccctcagcaccccctccctccccacctggccctcccaggacagctctcgccccccacaaaggggcatgggcctccagcctttgcccacaagtgcctcagtgcccactgggtcggcccccatggccaggagggctcaggacaatcctctatttcctgaccttttcctcgtccaccctgggcttggggacccccccaccggactctccactctccggcaggtcctaggggagccaccggaaggaaggagaggtttgcctgctcctacgggactgattcttctcttgccgacatgttttttgtaaggctggtaaataaattattttggacaaaactggagcagctgcccaaatgatagttttattttctgtccttgaaataaagaagccaattttataaaggggaaaacaata

SEQ ID NO: 335863 - DNA, 1099 bp, Homo sapiens
  misc_feature (1045)..(1045): n is a, c, g, or t
  misc_feature (1049)..(1049): n is a, c, g, or t
  misc_feature (1051)..(1051): n is a, c, g, or t
tggccacaccaggaggatgctgtggggtctgctgagtacagtgtgtgtacttgtgcacgcctggtccctaggagcacaggtggttagcgtatctgtgagggtgtgcccgcgtgtgtcacagctggtgctggggcaaccctaaagcctgggatcctgtaaacagtcctgcggcagccctgttctcccctctgtggagtggctgtgatcaccaaatctgccaccaggggcaacccagagcactcatggcccagcctgggcagaggccccggccagtggagctctcagatctgcagctctaaatcctagaatcccatgtggtctgctgtatggaggggacacttggctctggacatgcaacagggcaggtgaccagctcaccttgggatcatctccaggctcagtcaggcaaccaagaattcaggcagcagtcaaggcctaggaggcagcccgggtagtcacagccatacgaccatggccaacaaggtggagacgctgaaggaggaggaggaggagctgaagaggaaagtggagcaatgcagggacgagtacttggctgacctgtaccactttgttaccaaggaggactcctatgccaactacttcattcgtctcctggagattcaggccgattaccatcgcaggtcactgagctcgctggacacagccctggctgagctgagggagaaccacggccaagcagaccactccccttcgatgacagccacccacttccccagggtgtatggggtgtcgctggcaacccacctgcaagagctgggccgggagattgccctgcccatcgaggcctgcgtcatgatgctgctttctgagggcatgaaggaagagggtctcttccgtctggctgctggggcctcggtgctgaagcgtctcaagcagacaatggcctcggacccccacagcctggaggagttctgctccgacccgcacgctgtggcaggtgccctcaagtcctatctgcgggagctgccagagcctctgatgaccttcgacctctatgatgactggatgagggcagccagctganggancnaggggcacggtgcaggcctcaaaaaggtgttcacgcaacccccgaaaa

SEQ ID NO: 335864 - DNA, 777 bp, Homo sapiens
ctgccctgcccacccctctgtgacccttgcctgcctcctctcgaacccagggtctcttccgtctggctgctggggcctcggtgctgaagcgtctcaagcagacaatggcctcggacccccacagcctggaggagttctgctccgacccgcacgctgtggcaggtgccctcaagtcctatctgcgggagctgccagagcctctgatgaccttcgacctctatgatgactggatgagggcagccagcctgaaggagccaggggcccggctgcaggccctccaagaggtgtgcagccgcctaccccccgagaacctcagcaacctcaggtacctgatgaagttcctggcacggctggccgaggagcaggaggtgaacaagatgacacccagcaacatcgccatagtcctgggacccaacttgctgtggccacctgagaaagaaggggaccaggcccagctggatgcagcctccgtgtcttccatccaggtggtgggcgtcgtcgaggcgctgatccagagcgcagacaccctcttccctggagacatcaacttcaacgtgtcaggcctcttctcagctgttaccctccaggacacagtcagtgacaggctggcctctgaggaacttccgtccactgccgtgcccaccccagccaccaccccggctccggctccggctccagctccagctccggccccagccttggcttcagcagctaccaaggaaaggtgaggactgaggggcttgaatggctcctgtggtactcccacaatcagcctgc

SEQ ID NO: 335865 - DNA, 2379 bp, Homo sapiens
tggccacaccaggaggatgctgtggggtctgctgagtacagtgtgtgtacttgtgcacgcctggtccctaggagcacaggtggttagcgtatctgtgagggtgtgcccgcgtgtgtcacagctggtgctggggcaaccctaaagcctgggatcctgtaaacagtcctgcggcagccctgttctcccctctgtggagtggctgtgatcaccaaatctgccaccaggggcaacccagagcactcatggcccagcctgggcagaggccccggccagtggagctctcagatctgcagctctaaatcctagaatcccatgtggtctgctgtatggaggggacacttggctctggacatgcaacagggcaggtgaccagctcaccttgggatcatctccaggctcagtcaggcaaccaagaattcaggcagcagtcaaggcctaggaggcagcccgggtagtcacagccatacgaccatggccaacaaggtggagacgctgaaggaggaggaggaggagctgaagaggaaagtggagcaatgcagggacgagtacttggctgacctgtaccactttgttaccaaggaggactcctatgccaactacttcattcgtctcctggagattcaggccgattaccatcgcaggtcactgagctcgctggacacagccctggctgagctgagggagaaccacggccaagcagaccactccccttcgatgacagccacccacttccccagggtgtatggggtgtcgctggcaacccacctgcaagagctgggccgggagattgccctgcccatcgaggcctgcgtcatgatgctgctttctgagggcatgaaggaagagggtctcttccgtctggctgctggggcctcggtgctgaagcgtctcaagcagacaatggcctcggacccccacagcctggaggagttctgctccgacccgcacgctgtggcaggtgccctcaagtcctatctgcgggagctgccagagcctctgatgaccttcgacctctatgatgactggatgagggcagccagcctgaaggagccaggggcccggctgcaggccctccaagaggtgtgcagccgcctaccccccgagaacctcagcaacctcaggtacctgatgaagttcctggcacggctggccgaggagcaggaggtgaacaagatgacacccagcaacatcgccatagtcctgggacccaacttgctgtggccacctgagaaagaaggggaccaggcccagctggatgcagcctccgtgtcttccatccaggtggtgggcgtcgtcgaggcgctgatccagagcgcagacaccctcttccctggagacatcaacttcaacgtgtcaggcctcttctcagctgttaccctccaggacacagtcagtgacaggctggcctctgaggaacttccgtccactgccgtgcccaccccagccaccaccccggctccggctccggctccagctccagctccggccccagccttggcttcagcagctaccaaggaaaggacagagtctgaggtgcctcccagaccagcctcccccaaggtcaccaggagtcccccggagacagctgccccagtggaggacatggctcggaggaccaagcgcccggcgccagcccggcccaccatgccgcccccccaggtctccggctcccgctcctcccctccagccccgcccttgccccctggctctggcagccctgggaccccccaagccctgccccgacgtctggttggcagcagcctccgagcccccacagtgccacccccgttaccccccacaccccctcagcctgcccggcgccaaagccggcgttcaccagcctcccccagcccggcctccccaggtccagcctcccccagcccagtctctttgagtaaccctgcacaggtggacctgggggctgccacagcagagggaggagcccctgaggctatcagtggggtccccactcccccagctatcccccctcagccccgccccaggagccttgcctcagagaccaactgagtggctggtttctccctaagcagccctcagcaccccctccctccccacctggccctcccaggacagctctcgccccccacaaaggggcatgggcctccagcctttgcccacaagtgcctcagtgcccactgggtcggcccccatggccaggagggctcaggacaatcctctatttcctgaccttttcctcgtccaccctgggcttggggacccccccaccggactctccactctccggcaggtcctaggggagccaccggaaggaaggagaggtttgcctgctcctacgggactgattcttctcttgccgacatgttttttgtaaggctggtaaataaattattttggaca

SEQ ID NO: 335866 - DNA, 2134 bp, Homo sapiens
  misc_feature (2016)..(2016): n is a, c, g, or t
gacattggcagagctagctgaggttttattttggaccaaaaaaaaaaagcaattgaattgttttgtacctggaggcatgggcaaggggggtccccaggtagtaaactccccaggtgggctgagggctagggctgagcctcaggtgggtctcctgttcccagtgctaccctgcatagcggcctccttccggggcaagagccgcgccgcaggagaggcaggctggaccgggggctccccgggcccgcgacccccgccgtgaccccgcagcccccagctcgcccccaagatgatgaagaggcagctgcaccgcatgcggcagctggcccagacgggcagcttgggacgcaccccggagaccgctgagttcctgggtgaggacctgctgcaggtagaacagcggctggagccggccaagcgggcagcccacaacatccacaagcggctgcaggcctgtctgcagggccagagcggggcagacatggacaagcgggtgaagaagcttcccctcatggctctgtccaccacgatggctgagagcttcaaggagctggaccctgattccagcatggggaaggccttggagatgagctgtgccatccagaatcagctggcccgcatcctggccgagtttgagatgaccctggagagggacgtcctgcagccactcagcaggctgagtgaggaggagctgccagccatcctcaaacacaagaaaagcctccagaagctcgtgtccgactggaacacactcaagagcaggctcagtcaggcaaccaagaattcaggcagcagtcaaggcctaggaggcagcccgggtagtcacagccatacgaccatggccaacaaggtggagacgctgaaggaggaggaggaggagctgaagaggaaagtggagcaatgcagggacgagtacttggctgacctgtaccactttgttaccaaggaggactcctatgccaactacttcattcgtctcctggagattcaggccgattaccatcgcaggtcactgagctcgctggacacagccctggctgagctgagggagaaccacggccaagcagaccactccccttcgatgacagccacccacttccccagggtgtatggggtgtcgctggcaacccacctgcaagagctgggccgggagattgccctgcccatcgaggcctgcgtcatgatgctgctttctgagggcatgaaggaagagggtctcttccgtctggctgctggggcctcggtgctgaagcgtctcaagcagacaatggcctcggacccccacagcctggaggagttctgctccgacccgcacgctgtggcaggtgccctcaagtcctatctgcgggagctgccagagcctctgatgaccttcgacctctatgatgactggatgagggcagccagcctgaaggagccaggggcccggctgcaggccctccaagaggtgtgcagccgcctaccccccgagaacctcagcaacctcaggtacctgatgaagttcctggcacggctggccgaggagcaggaggtgaacaagatgacacccagcaacatcgccatagtcctgggacccaacttgctgtggccacctgagaaagaaggggaccaggcccagctggatgcagcctccgtgtcttccatccaggtggtgggcgtcgtcgaggcgctgatccagagcgcagacaccctcttccctggagacatcaacttcaacgtgtcaggcctcttctcagctgttaccctccaggacacagtcagtgacaggctggcctctgaggaacttccgtccactgccgtgcccaccccagccaccaccccggctccggctccggctccagctccagctccggccccagccttggcttcagcagctaccaaggaaaggacagagtctgaggtgcctcccagaccagcctcccccaaggtcaccaggagtcccccggagacagctgccccagtggaggacatggctcggaggaccaagcgcccggcgccagcccggtccaccatgtccgncgcacgccaggtctccgagtcgcgttcgctcgtgtcgagggctgaggaaggcttgtgcatccggcagagctgggacacaagaagaggaggagatcataaggacgcggtggaggaaatg

SEQ ID NO: 335867 - DNA, 1159 bp, Homo sapiens
gacattggcagagctagctgaggttttattttggaccaaaaaaaaaaagcaattgaattgttttgtacctggaggcatgggcaaggggggtccccaggtagtaaactccccaggtgggctgagggctagggctgagcctcaggtgggtctcctgttcccagtgctaccctgcatagcggcctccttccggggcaagagccgcgccgcaggagaggcaggctggaccgggggctccccgggcccgcgacccccgccgtgaccccgcagcccccagctcgcccccaagatgatgaagaggcagctgcaccgcatgcggcagctggcccagacgggcagcttgggacgcaccccggagaccgctgagttcctgggtgaggacctgctgcaggtagaacagcggctggagccggccaagcgggcagcccacaacatccacaagcggctgcaggcctgtctgcagggccagagcggggcagacatggacaagcgggtgaagaagcttcccctcatggctctgtccaccacgatggctgagagcttcaaggagctggaccctgattccagcatggggaaggccttggagatgagctgtgccatccagaatcagctggcccgcatcctggccgagtttgagatgaccctggagagggacgtcctgcagccactcagcaggctgagtgaggaggagctgccagccatcctcaaacacaagaaaagcctccagaagctcgtgtccgactggaacacactcaagagcaggctcagtcaggcaaccaagaattcaggcagcagtcaaggcctaggaggcagcccgggtagtcacagccatacgaccatggccaacaaggtggagacgctgaaggaggaggaggaggagctgaagaggaaagtggagcaatgcagggacgagtacttggctgacctgtaccactttgttaccaaggaggactcctatgccaactacttcattcgtctcctggagattcaggccgattaccatcgcaggtcactgagctcgctggacacagccctggctgagctgagggagaaccacggccaagcaggtggggacataggcccggcgataccacacccctgaccctgccctgctcggggcttattgagaagctcgcacttcatcctgaaaggtagcaggaag

SEQ ID NO: 335868 - DNA, 597 bp, Homo sapiens
aatgtggctgtgtcaccaccaagaacacgctgggcatttgacagcaattcaacatgagcttcagagacacccacaacagccaatgaggcagatgtttcagctgagcaaagcagatgtcagacaaggacagctactgtgtccagttgtttacagcaagcagctatttctctctccaccaagaataatctcaagacaaagaacaggcccataaccatttttccagaaccactttaaagatcatggttccatgacaaaggcaaaagtatcacagcacatgcagtcagcactcaaaagcccaaacacaagttcctttcctttgcagaactgaaaaacttttacagtacttgagaagggctcacaatgcctcctaaaaataagttgagggcgaacagctgataggcaactattacacagaataagttttgtagtctgtccagaaaataccatggagtaagcctttctcctgaattccaaggcagatttcctgcaactcccccacaaattagtgttaattttttttttttttttttgagacggggcctagctgtgtcacccaggctggagtgcagtggcgcaatctccactcattgcaagctc

SEQ ID NO: 335869 - DNA, 404 bp, Homo sapiens
cactgcaacaagacactgagaaaacactgaaatagtaggggccctaaggtatttaatttgtagagcatgtccagtgcctgaatgatgctgaaaatattttttgatgttgatgaacctcagtgttcttaaacagaaagtttcttgacatgtggataagctatcagctcttttttccagtaagtccaaacaggattgtgtactaatagtataatatggagaggaatatggaacaaatattggggaagaatgagctcaattttcattaaatgtatttcatcttctaaactttccaaggacttttttttttttttttttttttttttttttttttttttaagacaattccttttgggggccgggctggggggtcccgccggtgtatccccgagacttgggggagaggc

SEQ ID NO: 335870 - DNA, 585 bp, Homo sapiens
aatgctgctatcaaatagaggtgttgcttttcttttattcccttgttcttgaccctcctctggatggagattctgacagtacctcaggtagtgttgttagggtaaaaataatcaatgttcagtttttaaatgtaattatattattttacttctgaaatataccttcaaaactaaaggaaggtatgaggagaacagagctctgagtttttgctaagacaattgttgggaaaaagctgagtgtcgggagaaactgaggcagggcttgcatgtctgacatgtcctctggaatgtatctagacttgctggctttttgcttctagccttcctaggctcctactcccattatctcaagtagcagaacatgttccatataaatgctaaaccattacagctgtaaatcatgtgcttaatgcaatgtgtcctttccacctccacattctcaccacttgtttctttgttggattaccaataaatagcatgggctcccagagctcagggccttcacagcctccacaatggtgatggccccctgggaagagtgtaagccctggctgatacagaactgcgtgaagttctacgcacgcg

SEQ ID NO: 335871 - DNA, 546 bp, Homo sapiens
ggccgtaaaaagagatgattaagttaaatgagagtgttacagtagaacaaaacccaatcttatggtgaacttattgactgctctatacctaattgactctgctatggccacactgatcttcttcttcctctccttctcattcttcttctccatttttatttttgaaagatatgcttagatttgtcctctatttatttttaaattttatatgtataaatatatgtggtgcaatggtaattttgttatgcgcatatattgcatactgagtaattcagggatttagggtatccataaccagaataacatagagtgcatttattaattaatgtctcactattacctctctcccacctcctcacccttccaagtctacattgactgtcattccactctctacatctatgtaaacgcattctttttttttttaacaccacgtgtatgagtgagaacatgttatatttgattttctgtgtctggcctgtttcacttaacacatcatctgtcatgcccagttccactcatattgctgcaaagtgagtgatttta

SEQ ID NO: 335872 - DNA, 391 bp, Homo sapiens
gctcactttctgccgttccactggggtttgctctggaacatgcccctgctgctgcccaggcctcaccatgccccatccacccccgtcccaccagcctcgcaggatccacttgctgtaccttccacggtaacagtctcactaatctgggccagtgagctaattagaaggtttgagttctccagagccctcccctgcctttccaagaacagccacattttaatgggaacagttttctgcccctttttttttgttgcctaagagaagtagatctaatgatagtgatttcatacagggttggcttcatgcatcggttcacgacgttcaccccaattgcctaccgtgtgcatggcctggcactggggctgccatgcccagcagaagggaagatgta

SEQ ID NO: 335873 - DNA, 489 bp, Homo sapiens
tgtccatatttatcaagccacattcaaggaaatcatgtcttaactattttggatgttgcctctccttcaacttgtacatgaaactccagcagatttaatattggcatgcatcatctagtcaaacctctcacatgttcttcaaatcaatcaaatttgggattctcaacattttctgtgtcaataaaaggaatggaattagtagattcgatgaataactgtttttccttgccacactggacttccagacgccatttggattgggtttagaagatggggaagtttagaagatgtttcttggcctgagtctcttaagaggagagatgtagaagagagagtaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcg

SEQ ID NO: 335874 - DNA, 467 bp, Homo sapiens
catgttaatatcttagctcagacgagttttctttcagtccctgttgattcctgcattatatattcatcagtctggtaattaacatccagtcatccttgttgctctccttatgaactggctgtgtttaagggttctccacaccagtgggatttatgggaagtctgcatgtccaggcattatcttttatctgaaaacgagaaacatatagagatcaattatgataatctcctgcatggcagatgcagctctcgagggatttgttaccccatgacagcaaaatcaagccaggggctgctcggctcaccacttggacgcttgagcggagtggaatgataagtcatagactggtatttgaagctggcatggtagaaggcaggatggcctgcaaataaattacttcattttaggggcatgaagcctttgccaggatagaaatgtttggcattcatttcctagaggctactgga

SEQ ID NO: 335875 - DNA, 236 bp, Homo sapiens
cccaaccagactgtggtcagctagttcctgcaccttccacatataggaaactcacaactgaggctgcagtacctagacaggaccccctaccccgccgccactgcttgggtgttttgttcttatactaagtcaggcatacaaaaattacgttttaggtctgtagtgaataaatccttttcttagaaactaaatgagactagaacctttagaagccttcaatgagccctaaaaaggtc

SEQ ID NO: 335876 - DNA, 336 bp, Homo sapiens
ctcctgggttcaggggattctcctgcctcagcttcccaggtagctgggattacaggtgcatgccaccatgcccagctaatttttgtatttttagtagagacgggatttcaccatgttggccaggctggtctcatactcctgacctcagatgatccgcccccctcagccttccaaagtgctggggattacaggcatgagccactgcacctggccaggagagtttttttctgataatagaagtaatactttctcactttagaaaatgtgaaaagttcagatatataaggaagtcaaacaaaacgtctcctatatatgaagaagaaaagaagcaagttt

SEQ ID NO: 335877 - DNA, 686 bp, Homo sapiens
tatttccctaatgattagtagtgataagtacatgaaagattccttacatcactaatgagtagggctatctagtatgttagaatgagagaaaatgtatagaaataaaaagtattagatttatttagcaataaacacacagaaaacaaaatgaacaaatagaaaacaagtattaactttgtgtgaaaatgttgttctggaaaataaaaataatgatagtatactatgtggttcaggtgtaaataagtttcagtggttacaatgaggtaaatcctgaccactgatctaaatacaattaaaatctgattatttggggaggattatggtgttggaatctttcatgtagtagtggagataggaagatagaaggaaagaaaactaacaaagagataaatcctcatctttcacaatgagaagttaactgatcatgacagctgcggaaaagtaaatacataaaaaaaaagagcaagaaaataaaaaaatgaaaaatacatagttagcaaaataaaaagcataaagtaagatggtaggacacaataaaactgatccattctaacaatctaagtcaatgaagtaaactcggtgaaaaaacaaacattgtcagactaaatttttttttcagctattagtggtttatttgcttcagtaccatatttaatttttttattttagttttcctttatttcttc

SEQ ID NO: 335878 - DNA, 459 bp, Homo sapiens
tatttccctaatgattagtagtgataagtacatgaaagattccttacatcactaatgagtagggctatctagtatgttagaatgagagaaaatgtatagaaataaaaagtattagatttatttagcaataaacacacagaaaacaaaatgaacaaatagaaaacaagtattaactttgtgtgaaaatgttgttctggaaaataaaaataatgatagtatactatgtggttcaggtgtaaataagtttcagtggttacaatgaggtaaatcctgaccactgatctaaatacaattaaaatctgattatttggggaggattatggtgttggaatctttcatgtagtagtggagataggaagatagaagtatgttaatttagagataaacatttatattttttaatgagaagtttattgagggtgaaagatggggtagagaaaattattatgagaaaagaac

SEQ ID NO: 335879 - DNA, 418 bp, Homo sapiens
tatttccctaatgattagtagtgataagtacatgaaagattccttacatcactaatgagtagggctatctagtatgttagaatgagagaaaatgtatagaaataaaaagtattagatttatttagcaataaacacacagaaaacaaaatgaacaaatagaaaacaagtattaactttgtgtgaaaatgttgttctggaaaataaaaataatgatagtatactatgtggttcaggtgtaaataagtttcagtggttacaatgaggtaaatcctgaccactgatctaaatacaattaaaatctgattatttggggaggattatggtgttggaatctttcatgtagtagtggagataggaagatagaagttaaccacaggactaacctctttccttagtgcaacatgtgggaaaagagcac

SEQ ID NO: 335880 - DNA, 501 bp, Homo sapiens
tatttccctaatgattagtagtgataagtacatgaaagattccttacatcactaatgagtagggctatctagtatgttagaatgagagaaaatgtatagaaataaaaagtattagatttatttagcaataaacacacagaaaacaaaatgaacaaatagaaaacaagtattaactttgtgtgaaaatgttgttctggaaaataaaaataatgatagtatactatgtggttcaggtgtaaataagtttcagtggttacaatgaggtaaatcctgaccactgatctaaatacaattaaaatctgattatttggggaggattatggtgatgtaaaacatcttatggcaacggaagaaaggaaagggcccaactgctagccagccccatgagataggcctgtcgcttgaggaacagagatacaccctttggaaaccttgggtaatgggaaggcaacaaataaggccccgtgtgggggttttttgaacaaaagtttttttcatttt

SEQ ID NO: 335881 - DNA, 503 bp, Homo sapiens
cgaagagccaagtcactggacagcaggaccacaaagccctccgtgacgcccgacctgctgaatttcaagaaaggctggctgactaagcagtatgaggacagccagtggaagaaacactggtttgtcctcgccgatcaaagcctgagatactacagggattcagtggctgaggaggcagccgacttggatggagaaattgacttgtctgcatgttacgatgtcacagagtatccagttcagagaaactatggcttccagatacatacaaaggagggcgagtttaccccgtcggccatgacatctgggattcggcggaactggatccagaccatcatgaagcatgtgcacccgaccaccgccccggatgtgaccagctggttgccagaggaaaaaaacaagagcagctgctcttttgagacctgcccgaggcctactgagaagcaagaggcagagccgggggagccggaccctgagcagaagaggagccgcacgtgggagcggag

SEQ ID NO: 335882 - DNA, 408 bp, Homo sapiens
ctgaatggatggcacggtgccaactcttctgccatccgcccttgcagctttttttcttttcggcctccctccgattcttctgctcctcctcccgtcgacttgacgttaattaacactcgggttaattgattttaaaagccgaagaattacagttaacttttcccacagggtacagacgccagccgcttggcacactctgcttttcgcactggtgcaggggaacagggaaagcccgcagcaaagctagcaactgctgagggagcgttgcctgcttattggagtagagccgatagaagtcgacgtggcattgcctcatcctttacaatatatgtatccattatatattttgttaaataatcaaaacaccaccctgtttttcttcttctccgttcctctttcaaaacagga

SEQ ID NO: 335883 - DNA, 323 bp, Homo sapiens
gagggggctctcagccttccacctcggtggcagccagggtagatctgctgtcatcctaggcttctactgagacataattaggcatgtaggggaaatatagcagttgttaagataatctggcttggcatagtggctcaggcctgtaatcccaacactttgggaggccaaggcgggcaggtcacctgaggtcaggagttcgagaccagcctgaccaacatggagaaaccccatctctactaaaaataaaaaattagctgggcgtggtggtacatgcctgtaatcccagctacttgggaggctgaggcaggagaatcacttgaatc

SEQ ID NO: 335884 - DNA, 141 bp, Homo sapiens
gggcagggttagagcaagctagaattacacactgtctaaaagtattcacattattttaaaacactgtgccataaagcatgtctacaggtagatttgtcttacaagctgccaatttgggacccagttaacacaccttcccca

SEQ ID NO: 335885 - DNA, 2380 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335886 - DNA, 2003 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtgagggccggacctccacgagcggaatgcggggtccgaactcggggacggagaagggcagactagtcatcccggagaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcgttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335887 - DNA, 1754 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtgagggccggacctccacgagcggaatgcggggtcgcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcagcacttcctaaaagatgatggtgtgagcatccccggggagtacacttcctttctggctcccatctcttcctccaagctgtacaatgaggtccgagcctgtagggagaaggaccgtgaccctgaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagtgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgcacgaaaacatgctgccccctgccactatttt

SEQ ID NO: 335888 - DNA, 2410 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgcacgaaaacatgctgccccctgccactatttt

SEQ ID NO: 335889 - DNA, 2261 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335890 - DNA, 2465 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtgagggccggacctccacgagcggaatgcggggtccgaactcggggacggagaagggcagactagtcatcccggagaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335891 - DNA, 2589 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtgggtgagtccatgagaatcctgggatgggtgtggcttctcttacctcctgtgaataagaatcaggaatttcatatatagtatacaattttgctacttcccctctgtctcagactggctttctcttaaagaagtaaacagattttgcgcaaaggagcaaggaagggtttcttgcctggcagtggttgacagtttttcttttgcctcatgtagctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335892 - DNA, 2208 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335893 - DNA, 2333 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtgagggccggacctccacgagcggaatgcggggtccgaactcggggacggagaagggcagactagtcatcccggagaagcaggggtttgatttcctctgcatgcctgtcttccatccgcgtttcaagagggagttcattcaggaacctgctaagaatcggcccggtccccagacacgatcagacctactgctgtcaggaagggctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335894 - DNA, 2319 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335895 - DNA, 2306 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgcacgaaaacatgctgccccctgccactatttt

SEQ ID NO: 335896 - DNA, 2276 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335897 - DNA, 2116 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335898 - DNA, 2081 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggacagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcaagggctataactttatttgtatttcctcttacacaaaccatc

SEQ ID NO: 335899 - DNA, 2491 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaaggtaggaactgcttttaagactctctagttaagcagtaacctttgcctttggtgttgtgcttctttccttctcccaggaagatagttgactatgactcatgttctcctgatttcatatgctcttggatcccagtggtaggtgttgggagtatttggagtggccttctgcctggctttcccgcatctactctggctactcttctgtctgttctctactttgagcaagagtcatcttttaaaaactcaaatttgatcttatctctcttgctgtcttttttttttttttttttttaaagagacggagtctcactctgtcgcccaggctggagtgcagtggcacaatttcggctcactgcaagctccgcctcccgggttcatgccattctcctgcctcagcctccctgaggctgagattacaggtgccagccaccacacccggctaattcttgtatttttagtagagacggggttttaccgtgttagccaggatggtctcgatctcctgacctcatgatccgcccacctcagcctcccaaagtgctgggattacaggcgtgagccaccgcgcctggcctgatcttatctctcttttttgcttaaaactcttcaatgccttcccattgtctttaggataaaagtc

SEQ ID NO: 335900 - DNA, 1457 bp, Homo sapiens
catactgggggaagtcaggctctgacagcaagtgattcgttcactgagggtgcatatggcataacagctatgatggggagccgggcgtcaatatgcgtgcgtaccgtgcaccttccgcctcctaatattcccagtaacatgtataggtgtgcgagacagtagaatgttcgttaccggtatagttctttatactctactcgcatagataggggactgggataataataatattggttactagtcaatggatgctgtccagttgggtcggaaaaaaatagatattattcatcctatgtgggtaatagaggagtatgctaagactgggcagtagggtgggaaagaataagtcgggctcacctgccggttaggatgcataagattgagagaggtgagggaatgccaagtgagcgtaggtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335901 - DNA, 837 bp, Homo sapiens
tcaagatgagcggcaccggcttacttgtattccagtgtattggtgcgtgggagcaaatcctccttctctgatctgttgctttgtgccgttgtttaaaatttgttatcccaaaaacttgaggagccggaagatgagcctctggtgcatcttagaaagaacaggaaatcccttcttattggtcaggaaaatgctagtggggagaacggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335902 - DNA, 606 bp, Homo sapiens
atctccacacctaccttaatacattgccatgtataattcatagcttcaccctgaaccttcctgtctttcttcttacagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335903 - DNA, 425 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaaggggtagggaccatcccatatgccccttaattattagaggcaataacaacttctgctttatcggggccctcattctcctccttttctgacttggatatatttgttagt

SEQ ID NO: 335904 - DNA, 295 bp, Homo sapiens
caatgaggtccgagcctgtagggagaaggaccgtgaccctgaggtaaagaaccactctctctggaaagaagtggtactctttagtcctcttctttttctgtatttgcatcagctattttcttctgctggggatgaagaggtgaaggagaagttagggattggggaagcactaaagtaaaactttttttaatccttggggaagtagttctctcttgtgtgtcttccccaacactctctctctctttctgtctctgacaggcccagtttgagatgccttatgtggtacggctgcaca

SEQ ID NO: 335905 - DNA, 587 bp, Homo sapiens
agaagaggctaattttgacgggggaggcatgggcagaactggggcaaatctggatgtgatggtcttggaaacatactgacacctgaggagaaaaaaattctacttgtggatatccatcattttctccttactcatatgtcccatggctgtgttttagggagaaattgaggcacagtacagcagagttgatatcccccaaggtggtctgaactcagcagcctagtaggctgaactgatggcagctgaaagggctgtgcaaaatcaagatagcctaaatccagttgcttggctctctggcactgctgctgtctttacatgattctgggtctgtcgcggttgtaggtttgatttcctctgcatgcctgtcttccatccgcgtttcaagagggagttcattcaggaacctgctaagaatcggcccggtccccagacacgatcagacctactgctgtcaggaaggggtagggaccatcccatatgccccttaattattagaggcaataacaacttctgctttatcggggccctcattctcctccttttctgacttggatatatttgttagtccctgggatatagataacttg

SEQ ID NO: 335906 - DNA, 691 bp, Homo sapiens
gggattaacgaggtctggatgaagttttttttattgagggaaactttctggacccaatgagttcaaaagagagttctaaaagggtgactgttcatgtgcagttctggatgcgggtacccttggtggcaccagaggacctgagagatgatataattgagaatgcaccaactacacacacagaggagtacagtggggaggagaaaacgtggatgtggtatgtctccctttgctgctgtaccagggtgcaagggatagggtgaggggaagtacagggtgcaacctgtagggaggtctccttgagctgtggtgattggtcggccatatctagtttactgtacttttctgtatttgactgaacaggtggcacaacttccggactttgtgtgactatagtaagaggattgcagtgggtgagtccatgagaatcctgggatgggtgtggcttctcttacctcctgtgaataagaatcaggaatttcatatatagtatacaattttgctacttcccctctgtctcagactggctttctcttaaagaagtaaacagattttgcgcaaaggagcaaggaagggtttcttgcctggcagtggttgacagtttttcttttgcctcatgtagctcttgaaattggggctgacctcccatctaatcatgtcattgatcgctggcttggggagcccatcaaagcag

SEQ ID NO: 335907 - DNA, 2552 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggaactccgccgttaacagcactggtcgaagcatacggggtacgacgggaacatccagataacaggagaagccgcattagacgtgcaaaaaaaacaacagagcgcgggcacataaaagacccccacgagggcccaaaactaacagtagcacagacatctgcatacaaggggcacaaaagcaggggaatataaacgaagaacgcaagacatagaaagaggacgaggaaaagcgacacaggaacaccgtgagaac

SEQ ID NO: 335908 - DNA, 2416 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtgagggccggacctccacgagcggaatgcggggtcgtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335909 - DNA, 2410 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggtatttgtctttcttgggtgggggagtgcagactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335910 - DNA, 2248 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335911 - DNA, 2735 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtatgtctccctttgctgctgtaccagggtgcaagggatagggtgaggggaagtacagggtgcaacctgtagggaggtctccttgagctgtggtgattggtcggccatatctagtttactgtacttttctgtatttgactgaacaggtggcacaacttccggactttgtgtgactatagtaagaggattgcagtgggtgagtccatgagaatcctgggatgggtgtggcttctcttacctcctgtgaataagaatcaggaatttcatatatagtatacaattttgctacttcccctctgtctcagactggctttctcttaaagaagtaaacagattttgcgcaaaggagcaaggaagggtttcttgcctggcagtggttgacagtttttcttttgcctcatgtagctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335912 - DNA, 1807 bp, Homo sapiens
aagctgtgctgtcaagtccacgcagaccaaccttttggaattgctgcatccgcagaaacgcacacacgatggttagagcttcacgtaccgttatgggctgcttaatagggaagaggatgggaaaccatgagaacatcccaggagagtgagtctctggacggatactcagagtgatgtcctgataaagcacagtctcaaagtggccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335913 - DNA, 1918 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcgttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335914 - DNA, 2146 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgcacgaaaacatgctgccccctgccactatttt

SEQ ID NO: 335915 - DNA, 2189 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagaaccccacaggccgctcatataccattggcctctagccctgcgtgccaagtgtccagagccttggaagcagcttcaggttctgctcctgtagtacagaaggtgcggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgcacgaaaacatgctgccccctgccactatttt

SEQ ID NO: 335916 - DNA, 1169 bp, Homo sapiens
gattagactattttgggttctttcagttttaatctgtgtgactctgtaaattaacctagtagtggaatcctccatgacagtagttggaagcaggctggcttagtaatgtgacaacatgcatttgtctctttcttccatgcccatgccaacgttggttggttttgacatgggaggtttgatccttctgatccttcagttagtacagacataccatttccctccctctggaactaatttgactctcctgctgtgcagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 335917 - DNA, 948 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagccatgttacaggagctgaattttggtgcatatttgggtcttccagctttcctgctgccccttaatcaggaagcttgctag

SEQ ID NO: 335918 - DNA, 461 bp, Homo sapiens
atttgtaatgtgagctatgaaggaaaaggtagcgggaagaaagagggatgcgagcccttctactcttttaagggagggcctttggggaggtctttccagctgagggcacagcccaggcaaaggctcagaggcagaaagtgcaggagtgtgttgtgggtggggaggctaccaggcacctggtgtgtgcccggggagaagtcagaaaaaggcctggcctcggggggcccaggaagtggcttccagaggtggggagaaggcaaaagagaggactaaaccctttagtctgtttgagggaactccagcccccagcatgttgctctctgggggatccagcagggccaggtgggcagtgggagcaccctagccccaggtgctaccttccagcctggggccaagccttttccctttctctcatttgcagctttctgataggtgggaaagagaagcaggaaaaaagagca

SEQ ID NO: 335919 - DNA, 543 bp, Homo sapiens
tagagacggggtttcaccgtgttagccaggatggtctcgatctcctgaccttatgatctgcccgcctcggcctcccgaagtgctgggatgattacaggcgtgagccactgcgcctggccgcctgttgagggactttcatagtcatctcgtctgtggccttttgtgcctggctctcaccaggcattgcgtcttcggggtccatcgtgctgtggcatgatcagtgcttcatttggtttaaggctgaataatattccatgctctggccggacccttctcacctatagccatcgttagttgatgggcatctgggcgagttctgcttttcggctgttacaaatcatgctgctctgaacggccgcgtgtaagtttttgtgtggatgggtgtttcattcctcttgggtatatacctaggagtggagttgctgggacatatggtgactctgtgtttaaccttttgtggaactgccaagtattctctaaagtgtccccactgggggaaaaaaaagaaaatggaaaaaaaatcttgtggggaagggaatgatg

SEQ ID NO: 335920 - DNA, 170 bp, Homo sapiens
aacttaaaatgaaataaaataaaattttaaaaaactttattttgtctaaaattccaaaatgcagggattacaggcgtaagccaccgtgcctggccctgttttaacatatctgaacaagatttaagacatcagtttgaaaagagcccctctatggcagcaacatgaattct

SEQ ID NO: 335921 - DNA, 1192 bp, Homo sapiens
caggtttctacgtgacctctcagttattcccttacgccatgactcatcttttacgctcttgtccagaggcactatcagcagttttggataaagagccaaacagtaaatattttagactttacaggccacatatgatctctgtcacatagtcttaggtttttatatttttaaaggattgtttttaaaaaagattctctgctcatgggctggatttgggctgaatgctgtagtgtgtggaccccgtctagatcatcagaaggaaaaacattaaccttcagaatagggggtaattcgctgcaaaagtactatagaatggtctcatacataaattagtcaacatttgttatctcctgcaggtagaatattccgtggttgcttcttgaccaagggaaatacagtctggctgtgagagacttaaaatctcttgaggagcgctctggagaatggctgaaggagaggaaacaggagccttgagcagtgtaattacaaacaaataggttggcatagtcttaagtctttgagtctagagagatttgagttttgttttgcctgtggaggcaattgggggtttcaggtcaaagagagggtcagtggaaacaagggtgggccttgtgaggtgtggggaagccctgggaccctcactccccttccagtgtgtaactggattggctcccaccagcccagaagatttacgacgtgggaaatggtatacttggattaaaatatttcatccagatttgtttacatctagagagaaccccttgtaggttataaggaaactttttaacattcttccttgaatatattttctgtagctgaaaatgtttgtgaagtggctgtcaactacacatcgcatgagtagaggggctctgggtcggggtttcatatgcagcagagcagctcccttgctgccgtccatcaagagccctcaacacaagagtttgttataaatagaaataaacgacaaaaagtagaggggtatgtttaagtacactattagatgtgactgactaccttgaaacctgatttttttccatggggagaaacagtgcttgaattctgcatgccccccttgcatctagcaccttttggtaggggtggaaggagggtgtcagggagaatgattaggagataatggaggggaggggaaacttgcgttgtgtaatagcatttgaagagcacttaccacgtg

SEQ ID NO: 335922 - DNA, 981 bp, Homo sapiens
  misc_feature (920)..(920): n is a, c, g, or t
  misc_feature (927)..(928): n is a, c, g, or t
  misc_feature (931)..(931): n is a, c, g, or t
  misc_feature (933)..(933): n is a, c, g, or t
  misc_feature (935)..(935): n is a, c, g, or t
  misc_feature (946)..(946): n is a, c, g, or t
gaccacgaccgcgtccgggcgcgccacgtgtgcgtaggagcgcaccggaagcgcccggctggaggcgcggcggcagggctgggcggcggcggcggcggcggtcatggaacgccaagaggagtctctgtccgcgcggccggccctggagaccgaggggctgcgcttcctgcacaccacggtgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggaaaaagttacaaaggaaatgcaaagaagccccaggaggaagacagtcctgggccttccacttcatctgtcctgaaacggaaatcggacagaaagcctttgcggggaggaggttataacccgttgtctggtgaaggaggcggagcttgctcctggagacctggacgcagaggcccgtcatctggcggatgaggctaagaatcttgttaggtagaatattccgtggttgcttcttgaccaagggaaatacagtctggctgtgagagacttaaaatctcttgaggagcgctctggagaatggctgaaggagaggaaacaggagccttgagcagtgtaattacaaacaaataggttggcatagtcttaagtctttgagtctagagagatttgagttttgttttgcctgtggaggcaattgggggtttcaggtcaaagagagggtcgnggacagnnggntntngtttgggaccnggactctccctcggggttgttgcccacacaaattg

SEQ ID NO: 335923 - DNA, 1197 bp, Homo sapiens
gaccacgaccgcgtccgggcgcgccacgtgtgcgtaggagcgcaccggaagcgcccggctggaggcgcggcggcagggctgggcggcggcggcggcggcggtcatggaacgccaagaggagtctctgtccgcgcggccggccctggagaccgaggggctgcgcttcctgcacaccacggtgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggatccacttcatctgtcctgaaacggaaatcggacagaaagcctttgcggggaggaggttataacccgttgtctggtgaaggaggcggagcttgctcctggagacctggacgcagaggcccgtcatctggcggatgaggctaagaatcttgttagtgtcacttttgacattagcaagatgaacccttaaccctcgattcaattgccttacgcacgcttttcacagtgactagccaaggggaggtggggttgatttctgttcctaactacacctgcatatgtcagggctccagtcagcaaaaggtatagatgttgcctctaggcatgaggtcattggtcacattctacttggagacagtgattgcattcattgatttcatggttaattgctagttggtaggtaaaggcctctagatgattagcaatcttgataaaagaggcctagtaatgttcttttgaggttagaaatccttgctgctaggacagtctctgtgacaggttgcgttgaatgatgtcttccttatcaatggtgagcccaccagtgaggattactgatgtggacagttgatggggtttgtttctgtatatttatttttatgtacagaactttgtaaaaacgaaactatttaaaaaacaagaataacatttttagcatctttattcaaggagatttatggacttcaatttgtctatcaaacattaaatagctttttattacaacc

SEQ ID NO: 335924 - DNA, 920 bp, Homo sapiens
atcacaacagttttattaactaaagaaaacgagggtgaagtttgttctgaaagacatttaaattaagaattatcagagttagctttgtctttgagagaaatggcagcttctgaattctttctgtaaaatgtgattgtttctcagcttgaagaagaaaaaaggagacagaagattgaaatgtgggacagcatgcaagaaggatccacttcatctgtcctgaaacggaaatcggacagaaagcctttgcggggaggaggttataacccgttgtctggtgaaggaggcggagcttgctcctggagacctggacgcagaggcccgtcatctggcggatgaggctaagaatcttgttagtgtcacttttgacattagcaagatgaacccttaaccctcgattcaattgccttacgcacgcttttcacagtgactagccaaggggaggtggggttgatttctgttcctaactacacctgcatatgtcagggctccagtcagcaaaaggtatagatgttgcctctaggcatgaggtcattggtcacattctacttggagacagtgattgcattcattgatttcatggttaattgctagttggtaggtaaaggcctctagatgattagcaatcttgataaaagaggcctagtaatgttcttttgaggttagaaatccttgctgctaggacagtctctgtgacaggttgcgttgaatgatgtcttccttatcaatggtgagcccaccagtgaggattactgatgtggacagttgatggggtttgtttctgtatatttatttttatgtacagaactttgtaaaaacgaaactatttaaaaaacaagaataacatttttagcatctttattcaaggagatttatggacttcaatttgtctatcaaacattaaatagctttttattacaacc

SEQ ID NO: 335925 - DNA, 1196 bp, Homo sapiens
gaccacgaccgcgtccgggcgcgccacgtgtgcgtaggagcgcaccggaagcgcccggctggaggcgcggcggcagggctgggcggcggcggcggcggcggtcatggaacgccaagaggagtctctgtccgcgcggccggccctggagaccgaggggctgcgcttcctgcacaccacggtgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggaaaaagttacaaaggaaatgcaaagaagccccaggaggaagacagtcctgggccttccacttcatctgtcctgaaacggaaatcggacagaaagcctttgcggggaggaggttataacccgttgtctggtgaaggaggcggagcttgctcctggagacctggacgcagaggcccgtcatctggcggatgaggctaagaatcttgttagtgtcacttttgacattagcaagatgaacccttaaccctcgattcaattgccttacgcacgcttttcacagtgactagccaaggggaggtggggttgatttctgttcctaactacacctgcatatgtcagggctccagtcagcaaaagtgattgcattcattgatttcatggttaattgctagttggtaggtaaaggcctctagatgattagcaatcttgataaaagaggcctagtaatgttcttttgaggttagaaatccttgctgctaggacagtctctgtgacaggttgcgttgaatgatgtcttccttatcaatggtgagcccaccagtgaggattactgatgtggacagttgatggggtttgtttctgtatatttatttttatgtacagaactttgtaaaaacgaaactatttaaaaaacaagaataacatttttagcatctttattcaaggagatttatggacttcaatttgtctatcaaacattaaatagctttttattacaacc

SEQ ID NO: 335926 - DNA, 1372 bp, Homo sapiens
cgccacttttgcgacgcgcagccatgatggtgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggaaaaagttacaaaggaaatgcaaagaagccccaggaggaagacagtcctgggccttccacttcatctgtcctgaaacggaaatcggacagaaagcctttgcggggaggaggttataacccgttgtctggtgaaggaggcggagcttgctcctggagacctggacgcagaggcccgtcatctggcggatgaggctaagaatcttgttaggtagaatattccgtggttgcttcttgaccaagggaaatacagtctggctgtgagagacttaaaatctcttgaggagcgctctggagaatggctgaaggagaggaaacaggagccttgagcagtgtaattacaaacaaataggttggcatagtcttaagtctttgagtctagagagatttgagttttgttttgcctgtggaggcaattgggggtttcaggtcaaagagagggtcagtggaaacaagggtgggccttgtgaggtgtggggaagccctgggaccctcactccccttccagtgtgtaactggattggctcccaccagcccagaagatttacgacgtgggaaatggtatacttggattaaaatatttcatccagatttgtttacatctagagagaaccccttgtaggttataaggaaactttttaacattcttccttgaatatattttctgtagctgaaaatgtttgtgaagtggctgtcaactacacatcgcatgagtagaggggctctgggtcggggtttcatatgcagcagagcagctcccttgctgccgtccatcaagagccctcaacacaagagtttgttataaatagaaataaacgacaaaaagtagaggggtatgtttaagtacactattagatgtgactgactaccttgaaacctgatttttttccatggggagaaacagtgcttgaattctgcatgccccccttgcatctagcaccttttggtaggggtggaaggagggtgtcagggagaatgattaggagataatggaggggaggggaaacttgcgttgtgtaatagcatttgaagagcacttaccacgtg

SEQ ID NO: 335927 - DNA, 1251 bp, Homo sapiens
gaccacgaccgcgtccgggcgcgccacgtgtgcgtaggagcgcaccggaagcgcccggctggaggcgcggcggcagggctgggcggcggcggcggcggcggtcatggaacgccaagaggagtctctgtccgcgcggccggccctggagaccgaggggctgcgcttcctgcacaccacggtgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggaaaaagttacaaaggaaatgcaaagaagccccaggaggaagacagtcctgggccttccacttcatctgtcctgaaacggaaatcggacagaaagcctttgcggggaggaggttataacccgttgtctggtgaaggaggcggagcttgctcctggagacctggacgcagaggcccgtcatctggcggatgaggctaagaatcttgttagtgtcacttttgacattagcaagatgaacccttaaccctcgattcaattgccttacgcacgcttttcacagtgactagccaaggggaggtggggttgatttctgttcctaactacacctgcatatgtcagggctccagtcagcaaaaggtatagatgttgcctctaggcatgaggtcattggtcacattctacttggagacagtgattgcattcattgatttcatggttaattgctagttggtaggtaaaggcctctagatgattagcaatcttgataaaagaggcctagtaatgttcttttgaggttagaaatccttgctgctaggacagtctctgtgacaggttgcgttgaatgatgtcttccttatcaatggtgagcccaccagtgaggattactgatgtggacagttgatggggtttgtttctgtatatttatttttatgtacagaactttgtaaaaacgaaactatttaaaaaacaagaataacatttttagcatctttattcaaggagatttatggacttcaatttgtctatcaaacattaaatagctttttattacaacc

SEQ ID NO: 335928 - DNA, 1291 bp, Homo sapiens
cgccacttttgcgacgcgcagccatgatgggtgggtcgtccgccgctgcaccgggcgccggagcctgggaggcctgggaacggtcgggcgttggcgcttacgcggaccttgggcagcaggcccggaccttgcgcggaggcttctcgggagccgcacttccctgggcggctcggctgtcccttgtttgcgcaagtcttttttgcgaaccaagcccttccttgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggaaaaagttacaaaggaaatgcaaagaagccccaggaggaagacagtcctgggccttccacttcatctgtcctgaaacggaaatcggacagaaagcctttgcggggaggaggttataacccgttgtctggtgaaggaggcggagcttgctcctggagacctggacgcagaggcccgtcatctggcggatgaggctaagaatcttgttagtgtcacttttgacattagcaagatgaacccttaaccctcgattcaattgccttacgcacgcttttcacagtgactagccaaggggaggtggggttgatttctgttcctaactacacctgcatatgtcagggctccagtcagcaaaaggtatagatgttgcctctaggcatgaggtcattggtcacattctacttggagacagtgattgcattcattgatttcatggttaattgctagttggtaggtaaaggcctctagatgattagcaatcttgataaaagaggcctagtaatgttcttttgaggttagaaatccttgctgctaggacagtctctgtgacaggttgcgttgaatgatgtcttccttatcaatggtgagcccaccagtgaggattactgatgtggacagttgatggggtttgtttctgtatatttatttttatgtacagaactttgtaaaaacgaaactatttaaaaaacaagaataacatttttagcatctttattcaaggagatttatggacttcaatttgtctatcaaacattaaatagctttttattacaacc

SEQ ID NO: 335929 - DNA, 1302 bp, Homo sapiens
gaccacgaccgcgtccgggcgcgccacgtgtgcgtaggagcgcaccggaagcgcccggctggaggcgcggcggcagggctgggcggcggcggcggcggcggtcatggaacgccaagaggagtctctgtccgcgcggccggccctggagaccgaggggctgcgcttcctgcacaccacggtgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggaaaaagttacaaaggaaatgcaaagaagccccaggaggaagacagtcctgggccttccacttcatctgtcctgaaacggaaatcggacagaaagcctttgcggggaggaggttataacccgttgtctggtgaaggaggcggagcttgctcctggagacctggacgcagaggcccgtcatctggcggatgaggctaagaatcttgttagtgtcacttttgacattagcaagatgaacccttaaccctcgattcaattgccttacgcacgcttttcacagtgactagccaaggggaggtggggttgatttctgttcctaactacacctgcatatgtcagggctccagtcagcaaaaggtatagatgttgcctctaggcatgaggtcattggtcacattctacttggagacagtgattgcattcattgatttcatggttaattgctagttggtaggtaaaggcctctagatgattagcaatcttgataaaagaggcctagtaatgttcttttgaggttagaaatccttgctgctaggacagtctctgtgacaggttgcgttgaatgatgtcttccttatcaatggtgagcccaccagtgaggattactgatgtggacagttgatggggtttgtttctgtatatttatttttatgtacagaactttgtaaaaacgaaactatttaaaaaacaagaataacatttttagcatctttatttaatgtttgatagacaaatagcagtccataaatctccttgaatagagattctaaaaatgttattcttgttttttgtcccacggccgtgtatttagtagtagtagcggccgc

SEQ ID NO: 335930 - DNA, 1207 bp, Homo sapiens
gaccacgaccgcgtccgggcgcgccacgtgtgcgtaggagcgcaccggaagcgcccggctggaggcgcggcggcagggctgggcggcggcggcggcggcggtcatggaacgccaagaggagtctctgtccgcgcggccggccctggagaccgaggggctgcgcttcctgcacaccacggtgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggaaaaagttacaaaggaaatgcaaagaagccccaggaggaagacagtcctgggccttccacttcatctgtcctgaaacggaaatcggacagaaagcctttgcggggaggaggttataacccgttgtctggtgaaggaggcggagcttgctcctggagacctggactgtcacttttgacattagcaagatgaacccttaaccctcgattcaattgccttacgcacgcttttcacagtgactagccaaggggaggtggggttgatttctgttcctaactacacctgcatatgtcagggctccagtcagcaaaaggtatagatgttgcctctaggcatgaggtcattggtcacattctacttggagacagtgattgcattcattgatttcatggttaattgctagttggtaggtaaaggcctctagatgattagcaatcttgataaaagaggcctagtaatgttcttttgaggttagaaatccttgctgctaggacagtctctgtgacaggttgcgttgaatgatgtcttccttatcaatggtgagcccaccagtgaggattactgatgtggacagttgatggggtttgtttctgtatatttatttttatgtacagaactttgtaaaaacgaaactatttaaaaaacaagaataacatttttagcatctttattcaaggagatttatggacttcaatttgtctatcaaacattaaatagctttttattacaacc

SEQ ID NO: 335931 - DNA, 1521 bp, Homo sapiens
gaccacgaccgcgtccgggcgcgccacgtgtgcgtaggagcgcaccggaagcgcccggctggaggcgcggcggcagggctgggcggcggcggcggcggcggtcatggaacgccaagaggagtctctgtccgcgcggccggccctggagaccgaggggctgcgcttcctgcacaccacggtgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggaaaaagttacaaaggaaatgcaaagaagccccaggaggaagacagtcctgggccttccacttcatctgtcctgaaacggaaatcggacagaaagcctttgcggggaggaggttataacccgttgtctggtgaaggaggcggagcttgctcctggagacctggacgcagaggcccgtcatctggcggatgaggctaagaatcttgttaggtagaatattccgtggttgcttcttgaccaagggaaatacagtctggctgtgagagacttaaaatctcttgaggagcgctctggagaatggctgaaggagaggaaacaggagccttgagcagtgtaattacaaacaaataggttggcatagtcttaagtctttgagtctagagagatttgagttttgttttgcctgtggaggcaattgggggtttcaggtcaaagagagggtcagtggaaacaagggtgggccttgtgaggtgtggggaagccctgggaccctcactccccttccagtgtgtaactggattggctcccaccagcccagaagatttacgacgtgggaaatggtatacttggattaaaatatttcatccagatttgtttacatctagagagaaccccttgtaggttataaggaaactttttaacattcttccttgaatatattttctgtagctgaaaatgtttgtgaagtggctgtcaactacacatcgcatgagtagaggggctctgggtcggggtttcatatgcagcagagcagctcccttgctgccgtccatcaagagccctcaacacaagagtttgttataaatagaaataaacgacaaaaagtagaggggtatgtttaagtacactattagatgtgactgactaccttgaaacctgatttttttccatggggagaaacagtgcttgaattctgcatgccccccttgcatctagcaccttttggtaggggtggaaggagggtgtcagggagaatgattaggagataatggaggggaggggaaacttgcgttgtgtaatagcatttgaagagcacttaccacgtg

SEQ ID NO: 335932 - DNA, 1050 bp, Homo sapiens
gaccacgaccgcgtccgggcgcgccacgtgtgcgtaggagcgcaccggaagcgcccggctggaggcgcggcggcagggctgggcggcggcggcggcggcggtcatggaacgccaagaggagtctctgtccgcgcggccggccctggagaccgaggggctgcgcttcctgcacaccacggtgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggaggttataacccgttgtctggtgaaggaggcggagcttgctcctggagacctggacgcagaggcccgtcatctggcggatgaggctaagaatcttgttagtgtcacttttgacattagcaagatgaacccttaaccctcgattcaattgccttacgcacgcttttcacagtgactagccaaggggaggtggggttgatttctgttcctaactacacctgcatatgtcagggctccagtcagcaaaagtgattgcattcattgatttcatggttaattgctagttggtaggtaaaggcctctagatgattagcaatcttgataaaagaggcctagtaatgttcttttgaggttagaaatccttgctgctaggacagtctctgtgacaggttgcgttgaatgatgtcttccttatcaatggtgagcccaccagtgaggattactgatgtggacagttgatggggtttgtttctgtatatttatttttatgtacagaactttgtaaaaacgaaactatttaaaaaacaagaataacatttttagcatctttattcaaggagatttatggacttcaatttgtctatcaaacattaaatagctttttattacaacc

SEQ ID NO: 335933 - DNA, 157 bp, Homo sapiens
ctcagttttctcccaactcatacttttgaaatgcaagcgggcagaattgggaagtcattttcaaaaactaaattagttcaactaatcccttctttaactgggtaatttcttttcacattttcctctgtgtatgcttctgcttgtttgttttaaataa

SEQ ID NO: 335934 - DNA, 4879 bp, Homo sapiens
tgctccccgcgccgccgccgccgccgcctccgccgctgctgccgcacctgccaccatgtcgccgccgccgggtcatgtctgactctctctggaccgcgctttctaatttctcgatgccctccttccccggcggcagtatgttccgccgcaccaagagctgccgcaccagtaatcggaaaagcctcatcctgaccagcacttcacccacgctaccgagaccccactccccgctgccaggtcacctaggcagcagtcccctggacagcccccgaaacttctcccccaacacccccgcccacttctcgtttgcctcctcccgaagggcggacggacgccggtggtctctggcctcgctcccttcatctggctatggcaccaacacgcccagttccaccgtctcgtcctcctgctcctcccaggagcgccttcaccagctgccctaccagcccacggtggacgagctccacttcctctccaaacacttcgggagcaccgagagcatcacagacgaggatggtggccgtcgctccccagccgtgcggccccgctcacggagcctcagccccgggcgctccccctcctcctacgacaacgagatcgtgatgatgaatcacgtctacaaggagaggttcccgaaggccactgcgcagatggaggagaagctgcgcgactttacccgcgcctacgaacccgacagcgttctgcctctggccgatggcgtgctcagcttcatccaccaccagatcatcgagctggcccgggactgcctgaccaagtcccgtgacggcctcatcaccacggtctacttctatgaattgcaggagaacctggagaagctccttcaagacgcctatgaacgctctgagagcttggaggtggccttcgttactcagctggtgaagaagttgcttattatcatctcacgccctgcgaggctgctggagtgcctggaattcaaccccgaggagttctaccacctgctggaggcggccgaaggacacgccaaggagggccaccttgtgaagacggacatcccccgctacatcatccgccagctgggcctcacccgtgacccctttccagatgtggtgcatctggaggaacaggacagtggtggttccaacacccctgagcaagacgatctctctgagggccgcagcagcaaggccaagaaaccgccgggggagaatgacttcgataccatcaagctcataagcaacggtgcctacggcgctgtctacctggtgcggcaccgcgacacgcggcagcgctttgccatgaaaaagatcaacaagcagaacttgatcctccgcaaccagatccagcaggcctttgtggagcgcgatatcctcaccttcgccgagaacccgtttgtggtcggcatgttctgctcctttgagactcggcgccacctctgcatggtcatggaatatgtggaaggcggcgactgtgccaccctgctgaagaatattggagcgctgcccgtagagatggcccgcatgtactttgctgagacggtgctagccctggagtatttgcacaactatggcatcgtgcaccgcgacctcaagcctgacaacctccttatcacctccatgggtcacatcaagctcacagatttcggcctctccaagatggggctcatgagcctcaccaccaacttatatgaaggccacatcgagaaggacgcccgagagttcctggacaaacaggtgtgtgggaccccagagtacatcgcgcccgaggtcatcctgcgtcaaggctacggcaagccagtggactggtgggctatggggatcatcctctacgagttcctggtgggctgtgtgcccttcttcggagacacaccagaggagctatttggacaggtcatcagtgatgacatcctgtggcccgagggggatgaggccctacctacggaggcccaactcctcatatccagcctcctgcagaccaaccctctggtcaggcttggggcaggcggcgcttttgaggtgaagcagcacagtttctttcgagacctggactggacagggctgctgaggcagaaggccgagttcatcccccacctagagtcggaagatgacactagctactttgacacccgctcagacaggtatcaccacgtgaactcctatgacgaggatgacacgacggaggaggagcccgtggaaatccgccagttctcttcctgctctccgcgcttcagcaaggtgtatagcagcatggagcagctgtcgcagcacgagcccaagaccccagtagcagctgcagggagcagcaagcgggagccgagcaccaagggccccgaggagaaggtggccggcaagcgggaggggctgggcggcctgaccctgcgtgagaagacctggagagggggctctccggagatcaagcgattctccgcgtccgaggccagtttcctggagggagaggccagtccccctttgggcgcccgccgccgtttctcggcgctgctggagcccagccgcttcagcgccccccaagaggacgaggatgaggcccggctgcgcaggcctccccggcccagctccgaccccgcgggatccctggatgcacgggcccccaaagaggagactcaaggggaaggcacctccagcgccggggactccgaggccactgaccgtccacgcccaggtgacctctgcccaccctcgaaggatggggatgcatcaggcccaagggctaccaatgacttggttctgcgccgggcgcggcaccagcagatgtcaggggatgtggcagtagagaagaggccttctcgaactgggggcaaagtcatcaaatcagcctcagccactgccttatctgtcatgattcctgcagtggacccacatggaagttcaccccttgctagtcccatgtctccacgatctctgtcctccaacccatcctcacgggactcctcacccagccgggactactcaccagctgtcagtgggctccgctcccccatcaccatccagcgctcgggcaagaagtatggcttcacactgcgtgccatccgtgtctacatgggtgacacggatgtctatagtgtccaccacattgtctggcatgtggaggaaggaggcccagcccaggaggcaggactctgtgctggggacctcatcacccacgtgaatggggagcctgtgcatggcatggtgcatcctgaggtcgtggagctgatccttaagagtggcaacaaggtagcagtgaccacaacgcccttcgaaaatacctctatccgcattggtcccgcaaggcgcagcagctacaaggctaaaatggctcggaggaacaagcgaccctccgccaaggagggccaggagagcaagaagcgcagctccctcttccggaagatcacgaagcagtcgaacctgctgcatactagccgctcgctgtcgtcgctgaaccgctcgctgtcatccagcgatagtctcccgggctcgcctacgcacgggctgccggcgcgctcgcccacgcacagctaccgctccacgcctgactccgcctacctaggcgcctcatcccagagcagctccccagcctcgagcacgcccaactcgcctgcgtcgtcggcgtcgcaccacattcggcccagcacgctgcacggactgtcgccaaagctccatcgccagtaccgctctgcgcgatgcaagtcggccggcaacatccctctatcgccgctggcacacacgccgtcccccacgcaggcgtcaccgccgccactgccgggccacacggtgggcagctcgcacactactcagagcttcccggccaaactgcactcatcgcctcccgtcgtgcgcccgcgccccaagagtgccgagccccctcgctcgccgctcctcaagcgcgtgcagtcggccgagaagctgggagcctctttgagtgcggacaagaagggcgcgctgcgcaaacacagcctcgaggtgggccacccggatttccgcaaggacttccatggcgagctggcgctgcatagccttgccgagtccgacggtgagacgcccccagtcgagggccttggcgcgccccggcaggtcgccgtccgccgcctgggccgacaggagtcacctttgagcctgggcgcggacccgttgctgcccgagggtgcctccaggccaccagtgtcgagcaaggagaaggaatccccggggggcgccgaggcgtgcaccccaccccgcgcgacgacccccggtggccggaccctggagcgggacgtcggctgcacgcggcatcagagcgtgcagacggaggatggcactggcgggatggccagggctgtggccaaggcggcgctgagcccggtgcaggaacacgagacaggccggcgcagcagctctggcgaggcgggcacacccctggtacccattgtcgtagagcctgcgcggcccggggctaaggctgtggtgcctcagcctctgggcgcggactccaaggggttgcaggaacccgcacccctggcgccttccgtgcccgaggccccccggggccgggagcgctgggtgttggaggtggtggaggagcgcaccacgctgagcggtcctcgctccaagcccgcctccccaaagctctccccggagccccagacaccctccctagccccagcgaagtgcagtgcacccagcagtgcagtgaccccagtcccacccgcatccctcttgggctcgggcaccaagcctcaagtggggctgacctcccggtgccctgctgaagctgtgcccccagcaggcctgaccaaaaaaggagtgtccagtcccgcacccccgggaccatagccaagggggtcatcggccccgcgctgtacagcctccgtatacatatgtacacatataaataaagtgcgtccgtgctgcgtgaaatttctggg

SEQ ID NO: 335935 - DNA, 406 bp, Homo sapiens
tgagctgttggggggcccatggtggctctgaccccggccctgcccctgtccccagtcctcctgctcctcccaggagcgccttcaccagctgccctaccagcccacggtggacgagctccacttcctctccaaacacttcgggagcaccgagagcatcacagacgaggatggtggccgtcgctccccagccgtgcggccccgctcacggagcctcagccccgggcgctccccctcctcctacgacaacgagatcgtgatgatgaatcacgtctacaaggagaggttcccgaaggtgaggtgggacccgaggcggtcacggggtgaccaggcggcctgcactctcgctcgccttatccccgcgcgccccctggcggcctcggtgcgcagcgcaggctcctggcggccg

SEQ ID NO: 335936 - DNA, 4844 bp, Homo sapiens
gccgctacctccctcctccctccccgggccgaagtcgccgccgctgccgccatggacgattcgggcctcatccgccgccggaggctgcagaaggatttgcccctgccccggaaaagcagcagctgccgcaccagtaatcggaaaagcctcatcctgaccagcacttcacccacgctaccgagaccccactccccgctgccaggtcacctaggcagcagtcccctggacagcccccgaaacttctcccccaacacccccgcccacttctcgtttgcctcctcccgaagggcggacggacgccggtggtctctggcctcgctcccttcatctggctatggcaccaacacgcccagttccaccgtctcgtcctcctgctcctcccaggagcgccttcaccagctgccctaccagcccacggtggacgagctccacttcctctccaaacacttcgggagcaccgagagcatcacagacgaggatggtggccgtcgctccccagccgtgcggccccgctcacggagcctcagccccgggcgctccccctcctcctacgacaacgagatcgtgatgatgaatcacgtctacaaggagaggttcccgaaggccactgcgcagatggaggagaagctgcgcgactttacccgcgcctacgaacccgacagcgttctgcctctggccgatggcgtgctcagcttcatccaccaccagatcatcgagctggcccgggactgcctgaccaagtcccgtgacggcctcatcaccacggtctacttctatgaattgcaggagaacctggagaagctccttcaagacgcctatgaacgctctgagagcttggaggtggccttcgttactcagctggtgaagaagttgcttattatcatctcacgccctgcgaggctgctggagtgcctggaattcaaccccgaggagttctaccacctgctggaggcggccgaaggacacgccaaggagggccaccttgtgaagacggacatcccccgctacatcatccgccagctgggcctcacccgtgacccctttccagatgtggtgcatctggaggaacaggacagtggtggttccaacacccctgagcaagacgatctctctgagggccgcagcagcaaggccaagaaaccgccgggggagaatgacttcgataccatcaagctcataagcaacggtgcctacggcgctgtctacctggtgcggcaccgcgacacgcggcagcgctttgccatgaaaaagatcaacaagcagaacttgatcctccgcaaccagatccagcaggcctttgtggagcgcgatatcctcaccttcgccgagaacccgtttgtggtcggcatgttctgctcctttgagactcggcgccacctctgcatggtcatggaatatgtggaaggcggcgactgtgccaccctgctgaagaatattggagcgctgcccgtagagatggcccgcatgtactttgctgagacggtgctagccctggagtatttgcacaactatggcatcgtgcaccgcgacctcaagcctgacaacctccttatcacctccatgggtcacatcaagctcacagatttcggcctctccaagatggggctcatgagcctcaccaccaacttatatgaaggccacatcgagaaggacgcccgagagttcctggacaaacaggtgtgtgggaccccagagtacatcgcgcccgaggtcatcctgcgtcaaggctacggcaagccagtggactggtgggctatggggatcatcctctacgagttcctggtgggctgtgtgcccttcttcggagacacaccagaggagctatttggacaggtcatcagtgatgacatcctgtggcccgagggggatgaggccctacctacggaggcccaactcctcatatccagcctcctgcagaccaaccctctggtcaggcttggggcaggcggcgcttttgaggtgaagcagcacagtttctttcgagacctggactggacagggctgctgaggcagaaggccgagttcatcccccacctagagtcggaagatgacactagctactttgacacccgctcagacaggtatcaccacgtgaactcctatgacgaggatgacacgacggaggaggagcccgtggaaatccgccagttctcttcctgctctccgcgcttcagcaaggtgtatagcagcatggagcagctgtcgcagcacgagcccaagaccccagtagcagctgcagggagcagcaagcgggagccgagcaccaagggccccgaggagaaggtggccggcaagcgggaggggctgggcggcctgaccctgcgtgagaagacctggagagggggctctccggagatcaagcgattctccgcgtccgaggccagtttcctggagggagaggccagtccccctttgggcgcccgccgccgtttctcggcgctgctggagcccagccgcttcagcgccccccaagaggacgaggatgaggcccggctgcgcaggcctccccggcccagctccgaccccgcgggatccctggatgcacgggcccccaaagaggagactcaaggggaaggcacctccagcgccggggactccgaggccactgaccgtccacgcccaggtgacctctgcccaccctcgaaggatggggatgcatcaggcccaagggctaccaatgacttggttctgcgccgggcgcggcaccagcagatgtcaggggatgtggcagtagagaagaggccttctcgaactgggggcaaagtcatcaaatcagcctcagccactgccttatctgtcatgattcctgcagtggacccacatggaagttcaccccttgctagtcccatgtctccacgatctctgtcctccaacccatcctcacgggactcctcacccagccgggactactcaccagctgtcagtgggctccgctcccccatcaccatccagcgctcgggcaagaagtatggcttcacactgcgtgccatccgtgtctacatgggtgacacggatgtctatagtgtccaccacattgtctggcatgtggaggaaggaggcccagcccaggaggcaggactctgtgctggggacctcatcacccacgtgaatggggagcctgtgcatggcatggtgcatcctgaggtcgtggagctgatccttaagagtggcaacaaggtagcagtgaccacaacgcccttcgaaaatacctctatccgcattggtcccgcaaggcgcagcagctacaaggctaaaatggctcggaggaacaagcgaccctccgccaaggagggccaggagagcaagaagcgcagctccctcttccggaagatcacgaagcagtcgaacctgctgcatactagccgctcgctgtcgtcgctgaaccgctcgctgtcatccagcgatagtctcccgggctcgcctacgcacgggctgccggcgcgctcgcccacgcacagctaccgctccacgcctgactccgcctacctaggcgcctcatcccagagcagctccccagcctcgagcacgcccaactcgcctgcgtcgtcggcgtcgcaccacattcggcccagcacgctgcacggactgtcgccaaagctccatcgccagtaccgctctgcgcgatgcaagtcggccggcaacatccctctatcgccgctggcacacacgccgtcccccacgcaggcgtcaccgccgccactgccgggccacacggtgggcagctcgcacactactcagagcttcccggccaaactgcactcatcgcctcccgtcgtgcgcccgcgccccaagagtgccgagccccctcgctcgccgctcctcaagcgcgtgcagtcggccgagaagctgggagcctctttgagtgcggacaagaagggcgcgctgcgcaaacacagcctcgaggtgggccacccggatttccgcaaggacttccatggcgagctggcgctgcatagccttgccgagtccgacggtgagacgcccccagtcgagggccttggcgcgccccggcaggtcgccgtccgccgcctgggccgacaggagtcacctttgagcctgggcgcggacccgttgctgcccgagggtgcctccaggccaccagtgtcgagcaaggagaaggaatccccggggggcgccgaggcgtgcaccccaccccgcgcgacgacccccggtggccggaccctggagcgggacgtcggctgcacgcggcatcagagcgtgcagacggaggatggcactggcgggatggccagggctgtggccaaggcggcgctgagcccggtgcaggaacacgagacaggccggcgcagcagctctggcgaggcgggcacacccctggtacccattgtcgtagagcctgcgcggcccggggctaaggctgtggtgcctcagcctctgggcgcggactccaaggggttgcaggaacccgcacccctggcgccttccgtgcccgaggccccccggggccgggagcgctgggtgttggaggtggtggaggagcgcaccacgctgagcggtcctcgctccaagcccgcctccccaaagctctccccggagccccagacaccctccctagccccagcgaagtgcagtgcacccagcagtgcagtgaccccagtcccacccgcatccctcttgggctcgggcaccaagcctcaagtggggctgacctcccggtgccctgctgaagctgtgcccccagcaggcctgaccaaaaaaggagtgtccagtcccgcacccccgggaccatagccaagggggtcatcggccccgcgctgtacagcctccgtatacatatgtacacatataaataaagtgcgtccgtgctgcgtgaaatttctggg

SEQ ID NO: 335937 - DNA, 5016 bp, Homo sapiens
tgctccccgcgccgccgccgccgccgcctccgccgctgctgccgcacctgccaccatgtcgccgccgccgggtcatgtctgactctctctggaccgcgctttctaatttctcgatgccctccttccccggcggcagtatgttccgccgcaccaagagctgccgcaccagtaatcggaaaagcctcatcctgaccagcacttcacccacgctaccgagaccccactccccgctgccaggtcacctaggcagcagtcccctggacagcccccgaaacttctcccccaacacccccgcccacttctcgtttgcctcctcccgaagggcggacggacgccggtggtctctggcctcgctcccttcatctggctatggcaccaacacgcccagttccaccgtctcgtcctcctgctcctcccaggagcgccttcaccagctgccctaccagcccacggtggacgagctccacttcctctccaaacacttcgggagcaccgagagcatcacagacgaggatggtggccgtcgctccccagccgtgcggccccgctcacggagcctcagccccgggcgctccccctcctcctacgacaacgagatcgtgatgatgaatcacgtctacaaggagaggttcccgaaggccactgcgcagatggaggagaagctgcgcgactttacccgcgcctacgaacccgacagcgttctgcctctggccgatggcgtgctcagcttcatccaccaccagatcatcgagctggcccgggactgcctgaccaagtcccgtgacggcctcatcaccacggtctacttctatgaattgcaggagaacctggagaagctccttcaagacgcctatgaacgctctgagagcttggaggtggccttcgttactcagctggtgaagaagttgcttattatcatctcacgccctgcgaggctgctggagtgcctggaattcaaccccgaggagttctaccacctgctggaggcggccgaaggacacgccaaggagggccaccttgtgaagacggacatcccccgctacatcatccgccagctgggcctcacccgtgacccctttccagatgtggtgcatctggaggaacaggacagtggtggttccaacacccctgagcaagacgatctctctgagggccgcagcagcaaggccaagaaaccgccgggggagaatgacttcgataccatcaagctcataagcaacggtgcctacggcgctgtctacctggtgcggcaccgcgacacgcggcagcgctttgccatgaaaaagatcaacaagcagaacttgatcctccgcaaccagatccagcaggcctttgtggagcgcgatatcctcaccttcgccgagaacccgtttgtggtcggcatgttctgctcctttgagactcggcgccacctctgcatggtcatggaatatgtggaaggcggcgactgtgccaccctgctgaagaatattggagcgctgcccgtagagatggcccgcatgtactttgctgagacggtgctagccctggagtatttgcacaactatggcatcgtgcaccgcgacctcaagcctgacaacctccttatcacctccatgggtcacatcaagctcacagatttcggcctctccaagatggggctcatgagcctcaccaccaacttatatgaaggccacatcgagaaggacgcccgagagttcctggacaaacaggtgtgtgtgcgggcatgggggtcgctgagggtggagtgaccctgcaggacctcgggaacccagggcctggtggggggcacagctctcccttgagggccctcctctggctggggcgtgggctgacagcctgcccccaggtgtgtgggaccccagagtacatcgcgcccgaggtcatcctgcgtcaaggctacggcaagccagtggactggtgggctatggggatcatcctctacgagttcctggtgggctgtgtgcccttcttcggagacacaccagaggagctatttggacaggtcatcagtgatgacatcctgtggcccgagggggatgaggccctacctacggaggcccaactcctcatatccagcctcctgcagaccaaccctctggtcaggcttggggcaggcggcgcttttgaggtgaagcagcacagtttctttcgagacctggactggacagggctgctgaggcagaaggccgagttcatcccccacctagagtcggaagatgacactagctactttgacacccgctcagacaggtatcaccacgtgaactcctatgacgaggatgacacgacggaggaggagcccgtggaaatccgccagttctcttcctgctctccgcgcttcagcaaggtgtatagcagcatggagcagctgtcgcagcacgagcccaagaccccagtagcagctgcagggagcagcaagcgggagccgagcaccaagggccccgaggagaaggtggccggcaagcgggaggggctgggcggcctgaccctgcgtgagaagacctggagagggggctctccggagatcaagcgattctccgcgtccgaggccagtttcctggagggagaggccagtccccctttgggcgcccgccgccgtttctcggcgctgctggagcccagccgcttcagcgccccccaagaggacgaggatgaggcccggctgcgcaggcctccccggcccagctccgaccccgcgggatccctggatgcacgggcccccaaagaggagactcaaggggaaggcacctccagcgccggggactccgaggccactgaccgtccacgcccaggtgacctctgcccaccctcgaaggatggggatgcatcaggcccaagggctaccaatgacttggttctgcgccgggcgcggcaccagcagatgtcaggggatgtggcagtagagaagaggccttctcgaactgggggcaaagtcatcaaatcagcctcagccactgccttatctgtcatgattcctgcagtggacccacatggaagttcaccccttgctagtcccatgtctccacgatctctgtcctccaacccatcctcacgggactcctcacccagccgggactactcaccagctgtcagtgggctccgctcccccatcaccatccagcgctcgggcaagaagtatggcttcacactgcgtgccatccgtgtctacatgggtgacacggatgtctatagtgtccaccacattgtctggcatgtggaggaaggaggcccagcccaggaggcaggactctgtgctggggacctcatcacccacgtgaatggggagcctgtgcatggcatggtgcatcctgaggtcgtggagctgatccttaagagtggcaacaaggtagcagtgaccacaacgcccttcgaaaatacctctatccgcattggtcccgcaaggcgcagcagctacaaggctaaaatggctcggaggaacaagcgaccctccgccaaggagggccaggagagcaagaagcgcagctccctcttccggaagatcacgaagcagtcgaacctgctgcatactagccgctcgctgtcgtcgctgaaccgctcgctgtcatccagcgatagtctcccgggctcgcctacgcacgggctgccggcgcgctcgcccacgcacagctaccgctccacgcctgactccgcctacctaggcgcctcatcccagagcagctccccagcctcgagcacgcccaactcgcctgcgtcgtcggcgtcgcaccacattcggcccagcacgctgcacggactgtcgccaaagctccatcgccagtaccgctctgcgcgatgcaagtcggccggcaacatccctctatcgccgctggcacacacgccgtcccccacgcaggcgtcaccgccgccactgccgggccacacggtgggcagctcgcacactactcagagcttcccggccaaactgcactcatcgcctcccgtcgtgcgcccgcgccccaagagtgccgagccccctcgctcgccgctcctcaagcgcgtgcagtcggccgagaagctgggagcctctttgagtgcggacaagaagggcgcgctgcgcaaacacagcctcgaggtgggccacccggatttccgcaaggacttccatggcgagctggcgctgcatagccttgccgagtccgacggtgagacgcccccagtcgagggccttggcgcgccccggcaggtcgccgtccgccgcctgggccgacaggagtcacctttgagcctgggcgcggacccgttgctgcccgagggtgcctccaggccaccagtgtcgagcaaggagaaggaatccccggggggcgccgaggcgtgcaccccaccccgcgcgacgacccccggtggccggaccctggagcgggacgtcggctgcacgcggcatcagagcgtgcagacggaggatggcactggcgggatggccagggctgtggccaaggcggcgctgagcccggtgcaggaacacgagacaggccggcgcagcagctctggcgaggcgggcacacccctggtacccattgtcgtagagcctgcgcggcccggggctaaggctgtggtgcctcagcctctgggcgcggactccaaggggttgcaggaacccgcacccctggcgccttccgtgcccgaggccccccggggccgggagcgctgggtgttggaggtggtggaggagcgcaccacgctgagcggtcctcgctccaagcccgcctccccaaagctctccccggagccccagacaccctccctagccccagcgaagtgcagtgcacccagcagtgcagtgaccccagtcccacccgcatccctcttgggctcgggcaccaagcctcaagtggggctgacctcccggtgccctgctgaagctgtgcccccagcaggcctgaccaaaaaaggagtgtccagtcccgcacccccgggaccatagccaagggggtcatcggccccgcgctgtacagcctccgtatacatatgtacacatataaataaagtgcgtccgtgctgcgtgaaatttctggg

SEQ ID NO: 335938 - DNA, 1187 bp, Homo sapiens
tgctccccgcgccgccgccgccgccgcctccgccgctgctgccgcacctgccaccatgtcgccgccgccgggtcatgtctgactctctctggaccgcgctttctaatttctcgatgccctccttccccggcggcagtatgttccgccgcaccaagagctgccgcaccagtaatcggaaaagcctcatcctgaccagcacttcacccacgctaccgagaccccactccccgctgccaggtcacctaggcagcagtcccctggacagcccccgaaacttctcccccaacacccccgcccacttctcgtttgcctcctcccgaagggcggacggacgccggtggtctctggcctcgctcccttcatctggctatggcaccaacacgcccagttccaccgtctcgtcctcctgctcctcccaggagcgccttcaccagctgccctaccagcccacggtggacgagctccacttcctctccaaacacttcgggagcaccgagagcatcacagacgaggatggtggccgtcgctccccagccgtgcggccccgctcacggagcctcagccccgggcgctccccctcctcctacgacaacgagatcgtgatgatgaatcacgtctacaaggagaggttcccgaaggccactgcgcagatggaggagaagctgcgcgactttacccgcgcctacgaacccgacagcgttctgcctctggccgatggcgtgctcagcttcatccaccaccagatcatcgagctggcccgggactgcctgaccaagtcccgtgacggcctcatcaccacggtctacttctatgaattgcaggagaacctggagaagctccttcaagacgcctatgaacgctctgagagcttggaggtggccttcgttactcagctggtgaagaagttgcttattatcatctcacgccctgcgaggctgctggagtgcctggaattcaaccccgaggagttctaccacctgctggaggcggccgaaggacacgccaaggagggccaccttgtgaagacggacatcccccgctacatcatccgccagctgggcctcacccgtgacccctttccagatgtggtgcatctggaggaacaggacagtggtggttccaacacccctgagcaagacgatctctctgaggtaatggaatgacatcactcaaaatctaaaactcta

SEQ ID NO: 335939 - DNA, 419 bp, Homo sapiens
gctgggattacaggcacctgccaccacgcctggctcattttgcgtttttagtggagatggggtttcaccatgttggccaggctggtttcaaacttttgacctcaagtgatccacccacctcagcctcccaaagtgctgggattacaggcatgagccaccgtgcccagcctcattatttttactgtgtggcttgggcttcagtctcctcacctgtaagatgggacagtagcagcagtatgtactctgaggggctgagagaggggccgggctgaggcagagtgcctatgagccctgtccctctgtgtcccctgccacaggcctatgaacgctctgagagcttggaggtggccttcgttactcagctggtgaagaagttgcttattatcatctcacgccctgcgaggctgctggagtgcctg

SEQ ID NO: 335940 - DNA, 547 bp, Homo sapiens
gtgggctatggggatcatcctctacgagttcctggtgggctgtgtgcccttcttcggagacacaccagaggagctatttggacaggtcatcagtggtacgtggcttggcagtgtacaggggcagagtgtggtgtgcacggagagatggacaggctcagggttccagggatttcaaaagcgaccccccagaggatcgcttgcactcaggaggtcaaggctgcagtgagccatgatcgtgccactgcactccagctgggtgacacagtgagatcctgtgtccaaacaacaacaacaacaaaaaccgcccctaagttccgttttgttttgcagatgacatcctgtggcccgagggggatgaggccctacctacggaggcccaactcctcatatccagcctcctgcagaccaaccctctggtcaggcttggggcaggtaagtccgccatgcagaggagctgagggcccactgatagagagcaggcctccaaaaccccaggcccagcctgtgctgtggccccggggcggaagacatggggggcggggctggg

SEQ ID NO: 335941 - DNA, 470 bp, Homo sapiens
cactccagctgggtgacacagtgagatcctgtgtccaaacaacaacaacaacaaaaaccgcccctaagttccgttttgttttgcagatgacatcctgtggcccgagggggatgaggccctacctacggaggcccaactcctcatatccagcctcctgcagaccaaccctctggtcaggcttggggcaggtaagtccgccatgcagaggagctgagggcccactgatagagagcaggcctccaaaaccccaggcccagcctgtgctgtggccccggggcggaagacatggggggcggggctgggctgctgggttggccatcagctgtggctggaatcccttccgtcccaggcggcgcttttgaggtgaagcagcacagtttctttcgagacctggactggacagggctgctgaggcagaaggccgagttcatcccccacctagagtcggaagatgacactagctactttga

SEQ ID NO: 335942 - DNA, 951 bp, Homo sapiens
tggccttggactaattcctaacacacttgctttctgttgcagctgaccgtccacgcccaggtgacctctgcccaccctcgaaggatggggatgcatcaggcccaagggctaccaatgacttggttctgcgccgggcgcggcaccagcagatgtcaggggatgtggcagtagagaagaggccttctcgaactgggggcaaagtcatcaaatcagcctcagccactgccttatctgtcatgattcctgcagtggacccacatggaagttcaccccttgctagtcccatgtctccacgatctctgtcctccaacccatcctcacgggactcctcacccagccgggactactcaccagctgtcagtgggctccgctcccccatcaccatccagcgctcgggcaagaagtatggcttcacactgcgtgccatccgtgtctacatgggtgacacggatgtctatagtgtccaccacattgtctggcatgtggaggaaggaggcccagcccaggaggcaggactctgtgctggggacctcatcacccacgtgaatggggagcctgtgcatggcatggtgcatcctgaggtcgtggagctgatccttaagagtggcaacaaggtagcagtgaccacaacgcccttcgaaaatacctctatccgcattggtcccgcaaggcgcagcagctacaaggctaaaatggctcggaggaacaagcgaccctccgccaaggagggccaggagagcaagaagcgcagctccctcttccggaagatcacgaagcagtcgaacctgctgcatactagccgctcgctgtcgtcgctgaaccgctcgctgtcatccagcgatagtctcccgggctcgcctacgcacgggctgccggcgcgctcgcccacgcacagctaccgctccacgcctgactccgcctacctaggtattacctcctgcacctgcgcgg

SEQ ID NO: 335943 - DNA, 4272 bp, Homo sapiens
gccccgcgcccctcctccgtccctcccgcaggccactgcgcagatggaggagaagctgcgcgactttacccgcgcctacgaacccgacagcgttctgcctctggccgatggcgtgctcagcttcatccaccaccagatcatcgagctggcccgggactgcctgaccaagtcccgtgacggcctcatcaccacggtctacttctatgaattgcaggagaacctggagaagctccttcaagacgcctatgaacgctctgagagcttggaggtggccttcgttactcagctggtgaagaagttgcttattatcatctcacgccctgcgaggctgctggagtgcctggaattcaaccccgaggagttctaccacctgctggaggcggccgaaggacacgccaaggagggccaccttgtgaagacggacatcccccgctacatcatccgccagctgggcctcacccgtgacccctttccagatgtggtgcatctggaggaacaggacagtggtggttccaacacccctgagcaagacgatctctctgagggccgcagcagcaaggccaagaaaccgccgggggagaatgacttcgataccatcaagctcataagcaacggtgcctacggcgctgtctacctggtgcggcaccgcgacacgcggcagcgctttgccatgaaaaagatcaacaagcagaacttgatcctccgcaaccagatccagcaggcctttgtggagcgcgatatcctcaccttcgccgagaacccgtttgtggtcggcatgttctgctcctttgagactcggcgccacctctgcatggtcatggaatatgtggaaggcggcgactgtgccaccctgctgaagaatattggagcgctgcccgtagagatggcccgcatgtactttgctgagacggtgctagccctggagtatttgcacaactatggcatcgtgcaccgcgacctcaagcctgacaacctccttatcacctccatgggtcacatcaagctcacagatttcggcctctccaagatggggctcatgagcctcaccaccaacttatatgaaggccacatcgagaaggacgcccgagagttcctggacaaacaggtgtgtgggaccccagagtacatcgcgcccgaggtcatcctgcgtcaaggctacggcaagccagtggactggtgggctatggggatcatcctctacgagttcctggtgggctgtgtgcccttcttcggagacacaccagaggagctatttggacaggtcatcagtgatgacatcctgtggcccgagggggatgaggccctacctacggaggcccaactcctcatatccagcctcctgcagaccaaccctctggtcaggcttggggcaggcggcgcttttgaggtgaagcagcacagtttctttcgagacctggactggacagggctgctgaggcagaaggccgagttcatcccccacctagagtcggaagatgacactagctactttgacacccgctcagacaggtatcaccacgtgaactcctatgacgaggatgacacgacggaggaggagcccgtggaaatccgccagttctcttcctgctctccgcgcttcagcaaggtgtatagcagcatggagcagctgtcgcagcacgagcccaagaccccagtagcagctgcagggagcagcaagcgggagccgagcaccaagggccccgaggagaaggtggccggcaagcgggaggggctgggcggcctgaccctgcgtgagaagacctggagagggggctctccggagatcaagcgattctccgcgtccgaggccagtttcctggagggagaggccagtccccctttgggcgcccgccgccgtttctcggcgctgctggagcccagccgcttcagcgccccccaagaggacgaggatgaggcccggctgcgcaggcctccccggcccagctccgaccccgcgggatccctggatgcacgggcccccaaagaggagactcaaggggaaggcacctccagcgccggggactccgaggccactgaccgtccacgcccaggtgacctctgcccaccctcgaaggatggggatgcatcaggcccaagggctaccaatgacttggttctgcgccgggcgcggcaccagcagatgtcaggggatgtggcagtagagaagaggccttctcgaactgggggcaaagtcatcaaatcagcctcagccactgccttatctgtcatgattcctgcagtggacccacatggaagttcaccccttgctagtcccatgtctccacgatctctgtcctccaacccatcctcacgggactcctcacccagccgggactactcaccagctgtcagtgggctccgctcccccatcaccatccagcgctcgggcaagaagtatggcttcacactgcgtgccatccgtgtctacatgggtgacacggatgtctatagtgtccaccacattgtctggcatgtggaggaaggaggcccagcccaggaggcaggactctgtgctggggacctcatcacccacgtgaatggggagcctgtgcatggcatggtgcatcctgaggtcgtggagctgatccttaagagtggcaacaaggtagcagtgaccacaacgcccttcgaaaatacctctatccgcattggtcccgcaaggcgcagcagctacaaggctaaaatggctcggaggaacaagcgaccctccgccaaggagggccaggagagcaagaagcgcagctccctcttccggaagatcacgaagcagtcgaacctgctgcatactagccgctcgctgtcgtcgctgaaccgctcgctgtcatccagcgatagtctcccgggctcgcctacgcacgggctgccggcgcgctcgcccacgcacagctaccgctccacgcctgactccgcctacctaggcgcctcatcccagagcagctccccagcctcgagcacgcccaactcgcctgcgtcgtcggcgtcgcaccacattcggcccagcacgctgcacggactgtcgccaaagctccatcgccagtaccgctctgcgcgatgcaagtcggccggcaacatccctctatcgccgctggcacacacgccgtcccccacgcaggcgtcaccgccgccactgccgggccacacggtgggcagctcgcacactactcagagcttcccggccaaactgcactcatcgcctcccgtcgtgcgcccgcgccccaagagtgccgagccccctcgctcgccgctcctcaagcgcgtgcagtcggccgagaagctgggagcctctttgagtgcggacaagaagggcgcgctgcgcaaacacagcctcgaggtgggccacccggatttccgcaaggacttccatggcgagctggcgctgcatagccttgccgagtccgacggtgagacgcccccagtcgagggccttggcgcgccccggcaggtcgccgtccgccgcctgggccgacaggagtcacctttgagcctgggcgcggacccgttgctgcccgagggtgcctccaggccaccagtgtcgagcaaggagaaggaatccccggggggcgccgaggcgtgcaccccaccccgcgcgacgacccccggtggccggaccctggagcgggacgtcggctgcacgcggcatcagagcgtgcagacggaggatggcactggcgggatggccagggctgtggccaaggcggcgctgagcccggtgcaggaacacgagacaggccggcgcagcagctctggcgaggcgggcacacccctggtacccattgtcgtagagcctgcgcggcccggggctaaggctgtggtgcctcagcctctgggcgcggactccaaggggttgcaggaacccgcacccctggcgccttccgtgcccgaggccccccggggccgggagcgctgggtgttggaggtggtggaggagcgcaccacgctgagcggtcctcgctccaagcccgcctccccaaagctctccccggagccccagacaccctccctagccccagcgaagtgcagtgcacccagcagtgcagtgaccccagtcccacccgcatccctcttgggctcgggcaccaagcctcaagtggggctgacctcccggtgccctgctgaagctgtgcccccagcaggcctgaccaaaaaaggagtgtccagtcccgcacccccgggaccatagccaagggggtcatcggccccgcgctgtacagcctccgtatacatatgtacacatataaataaagtgcgtccgtgctgcgtgaaatttctggg

SEQ ID NO: 335944 - DNA, 1988 bp, Homo sapiens
tgctccccgcgccgccgccgccgccgcctccgccgctgctgccgcacctgccaccatgtcgccgccgccgggtcatgtctgactctctctggaccgcgctttctaatttctcgatgccctccttccccggcggcagtatgttccgccgcaccaagagctgccgcaccagtaatcggaaaagcctcatcctgaccagcacttcacccacgctaccgagaccccactccccgctgccaggtcacctaggcagcagtcccctggacagcccccgaaacttctcccccaacacccccgcccacttctcgtttgcctcctcccgaagggcggacggacgccggtggtctctggcctcgctcccttcatctggctatggcaccaacacgcccagttccaccgtctcgtcctcctgctcctcccaggagcgccttcaccagctgccctaccagcccacggtggacgagctccacttcctctccaaacacttcgggagcaccgagagcatcacagacgaggatggtggccgtcgctccccagccgtgcggccccgctcacggagcctcagccccgggcgctccccctcctcctacgacaacgagatcgtgatgatgaatcacgtctacaaggagaggttcccgaaggccactgcgcagatggaggagaagctgcgcgactttacccgcgcctacgaacccgacagcgttctgcctctggccgatggcgtgctcagcttcatccaccaccagatcatcgagctggcccgggactgcctgaccaagtcccgtgacggcctcatcaccacggtctacttctatgaattgcaggagaacctggagaagctccttcaagacgcctatgaacgctctgagagcttggaggtggccttcgttactcagctggtgaagaagttgcttattatcatctcacgccctgcgaggctgctggagtgcctggaattcaaccccgaggagttctaccacctgctggaggcggccgaaggacacgccaaggagggccaccttgtgaagacggacatcccccgctacatcatccgccagctgggcctcacccgtgacccctttccagatgtggtgcatctggaggaacaggacagtggtggttccaacacccctgagcaagacgatctctctgagggccgcagcagcaaggccaagaaaccgccgggggagaatgacttcgataccatcaagctcataagcaacggtgcctacggcgctgtctacctggtgcggcaccgcgacacgcggcagcgctttgccatgaaaaagatcaacaagcagaacttgatcctccgcaaccagatccagcaggcctttgtggagcgcgatatcctcaccttcgccgagaacccgtttgtggtcggcatgttctgctcctttgagactcggcgccacctctgcatggtcatggaatatgtggaaggtgtggctgcctgcggggctgcagggaagatggggccgtgctcactggtcagggctgcggggtggcctgcctgagccgcagtctccatattgattagtcggcctggtatgtttatccatctatttatttctccagtcattgatttgtccatccattctacctatatatttattcagtcatctattggtttatttgtttttcatttcattcagcataaaaacattcagtctgacccattatccatccatctatccttctatctactgatgtgctaatccatctgtttttccatccatacatccatgaacctgtttttatttatttatttatttattcatttattcatttatttattttttgagacagagtcttgctctgtcacccaggctgcagtgcagtggtgcaatctcggttcactgcaacctccgactcccaggctcaagcgattcttatgcctcagcctcccgagtagctgggattatgggcctgtgccaccattcatgggtaatttttctatttttagcagagacaggatttcgccatgtttg

SEQ ID NO: 335945 - DNA, 368 bp, Homo sapiens
actagagagaggtactagcgctcagaatggcctggggtgatgccagggtgcagagcactgtaggtggagcgtggcctctttggaggcggggctagacggtgccactgagaatggggcaaggaccttgcctgggagcggagcctaaattaaatacactaatgaggcaggggcgtggcctgacctgaagacttgtaaacccgtcttgaaccaggactgggctcctgtggggatgtgatatgaggaggaaccccgtaccctcagtcacagcccatacccgctccccagcccgctcagacaggtatcaccacgtgaactcctatgacgaggatgacacgacggaggaggagcccgtggaaatccgccagttc

SEQ ID NO: 335946 - DNA, 461 bp, Homo sapiens
attgtctttatccataaaggagattctgaatttttagagttcctgaatattttcccccaagtttctgtcaaattcctgaagtcccttccctatcacactcagtttcctgaagctcttcccctacacctgctcctctgtctggctaacagagttgtcatgtctcagaaactactcaccactcttgtgagactctcttcccaagcatcatccttcctcaggatgaggcctttttctactacccaagagatcaagaccctttttctaacaagacaaggttatatctactccattttcaagagaaataacccctctggttcccatgcaaatcgcttaaattccttcatcaccagaatctctccaacaggcccaactccagcccagctgtgaacactgctgtcatggagacaactccaaaatgaaagaactatgcaattgcctgaaggtgctaatggagagccagt

SEQ ID NO: 335947 - DNA, 158 bp, Homo sapiens
ccagattccagaaaaggtcctgcttcacacccagaaggaaggaatacaagttcagagaggcccacaacaatctagacagataggcctggctggggttccccacttagtctattagcattacagcatacctgtttggtccaatcatatttctacccaac

SEQ ID NO: 335948 - DNA, 670 bp, Homo sapiens
aataagcaacctaaggtactgagggtttaaacgtctttagcaagtttatcaaagtcagtgacctggcagacccaggaattgtaattttgagccatagcccacaccacatattgagaaaactagaagagaatgaacttggccagaggagaatgaaatggcttgatatagatgaagatgcagctgccataagtgatggaaaccacagtaatatgtgaagaacagttgttcatgtattctagaggaaaagaaaggaatatcattatatactgcttatgggattctgtgctgcggagatcattacggaagcaacagtagcaggtggcctggccatacagggattccttactcgcagcagagaatgttgctgccactcaaagtcaccaggggctgaagagctcctgtggagacccacatcatctaacaacacacatactcaaaacagggaaatgtgcattttcgggagaggaagagacaaaccttttgtttagctaactggcatgacagagtgtgacatacatgtgctcctggaagaacggtgttgggtgtctgcactcaaaatcttgagcataggcaactggatgaagggctctgtggcattgattttcattgtgtgtgtgttaatatttacatttataattaaataaataatcgaaattatgctgaactgaaa

SEQ ID NO: 335949 - DNA, 531 bp, Homo sapiens
ctgagatatggggagcgcctctgccccgccgcccatctgggatgcgaggagcgcctctgcccggccgcgaccccgtctgggagttgttcatgtattctagaggaaaagaaaggaatatcattatatactgcttatgggattctgtgctgcggagatcattacggaagcaacagtagcaggtggcctggccatacagggattccttactcgcagcagagaatgttgctgccactcaaagtcaccaggggctgaagagctcctgtggagacccacatcatctaacaacacacatactcaaaacagggaaatgtgcattttcgggagaggaagagacaaaccttttgtttagctaactggcatgacagagtgtgacatacatgtgctcctggaagaacggtgttgggtgtctgcactcaaaatcttgagcataggcaactggatgaagggctctgtggcattgattttcattgtgtgtgtgttaatatttacatttataattaaataaataatcgaaattatgctgaactgaaa

SEQ ID NO: 335950 - DNA, 615 bp, Homo sapiens
aataagcaacctaaggtactgagggtttaaacgtctttagcaagtttatcaaagtcagtgacctggcagacccaggaattgtaattttgagccatagcccacaccacatattgagaaaactagaagagaatgaacttggccagaggagaatgaaatggcttgatatagatgaagatgcagctgccataagtgatggaaaccacagtaatatgtgaagaacggattctgtgctgcggagatcattacggaagcaacagtagcaggtggcctggccatacagggattccttactcgcagcagagaatgttgctgccactcaaagtcaccaggggctgaagagctcctgtggagacccacatcatctaacaacacacatactcaaaacagggaaatgtgcattttcgggagaggaagagacaaaccttttgtttagctaactggcatgacagagtgtgacatacatgtgctcctggaagaacggtgttgggtgtctgcactcaaaatcttgagcataggcaactggatgaagggctctgtggcattgattttcattgtgtgtgtgttaatatttacatttataattaaataaataatcgaaattatgctgaactgaaa

SEQ ID NO: 335951 - DNA, 447 bp, Homo sapiens
aaaaaaaatataaattactaagtccaacaaaaaataaaacaaaacacttgagggattctgtgctgcggagatcattacggaagcaacagtagcaggtggcctggccatacagggattccttactcgcagcagagaatgttgctgccactcaaagtcaccaggggctgaagagctcctgtggagacccacatcatctaacaacacacatactcaaaacagggaaatgtgcattttcgggagaggaagagacaaaccttttgtttagctaactggcatgacagagtgtgacatacatgtgctcctggaagaacggtgttgggtgtctgcactcaaaatcttgagcataggcaactggatgaagggctctgtggcattgattttcattgtgtgtgtgttaatatttacatttataattaaataaataatcgaaattatgctgaactgaaa

SEQ ID NO: 335952 - DNA, 444 bp, Homo sapiens
  misc_feature (52)..(52): n is a, c, g, or t
  misc_feature (62)..(62): n is a, c, g, or t
  misc_feature (64)..(64): n is a, c, g, or t
  misc_feature (66)..(66): n is a, c, g, or t
  misc_feature (72)..(72): n is a, c, g, or t
tatttataatataatataataaaataaagaaacaaaaccctcagggtaacgngctgcgggtncntncggaantacggaagcaacagtagcaggtggcctggccatacagggattccttactcgcagcagagaatgttgctgccactcaaagtcaccaggggctgaagagctcctgtggagacccacatcatctaacaacacacatactcaaaacagggaaatgtgcattttcgggagaggaagagacaaaccttttgtttagctaactggcatgacagagtgtgacatacatgtgctcctggaagaacggtgttgggtgtctgcactcaaaatcttgagcataggcaactggatgaagggctctgtggcattgattttcattgtgtgtgtgttaatatttacatttataattaaataaataatcgaaattatgctgaactgaaa

SEQ ID NO: 335953 - DNA, 455 bp, Homo sapiens
  misc_feature (44)..(44): n is a, c, g, or t
  misc_feature (50)..(50): n is a, c, g, or t
  misc_feature (54)..(54): n is a, c, g, or t
  misc_feature (69)..(69): n is a, c, g, or t
  misc_feature (80)..(80): n is a, c, g, or t
ggccggagggcacgctgggcccgacgcgctgagttttcgccagnaattcngttntatcagcgctgtttnatacatacggnagatacggaagcaacagtagcaggtggcctggccatacagggattccttactcgcagcagagaatgttgctgccactcaaagtcaccaggggctgaagagctcctgtggagacccacatcatctaacaacacacatactcaaaacagggaaatgtgcattttcgggagaggaagagacaaaccttttgtttagctaactggcatgacagagtgtgacatacatgtgctcctggaagaacggtgttgggtgtctgcactcaaaatcttgagcataggcaactggatgaagggctctgtggcattgattttcattgtgtgtgtgttaatatttacatttataattaaataaataatcgaaattatgctgaactgaaa

SEQ ID NO: 335954 - DNA, 439 bp, Homo sapiens
  misc_feature (67)..(67): n is a, c, g, or t
tattttttcagataatgtccattcttataaaaaccaaacaagcccctcgagggtaacgtgctgcggntacggaagcaacagtagcaggtggcctggccatacagggattccttactcgcagcagagaatgttgctgccactcaaagtcaccaggggctgaagagctcctgtggagacccacatcatctaacaacacacatactcaaaacagggaaatgtgcattttcgggagaggaagagacaaaccttttgtttagctaactggcatgacagagtgtgacatacatgtgctcctggaagaacggtgttgggtgtctgcactcaaaatcttgagcataggcaactggatgaagggctctgtggcattgattttcattgtgtgtgtgttaatatttacatttataattaaataaataatcgaaattatgctgaactgaaa

SEQ ID NO: 335955 - DNA, 453 bp, Homo sapiens
  misc_feature (73)..(73): n is a, c, g, or t
gccggcccgctgccagcagtgatatagagtaaaagtagtgacggttataaggtagtaacatgaggagtatctngctgcggctacggaagcaacagtagcaggtggcctggccatacagggattccttactcgcagcagagaatgttgctgccactcaaagtcaccaggggctgaagagctcctgtggagacccacatcatctaacaacacacatactcaaaacagggaaatgtgcattttcgggagaggaagagacaaaccttttgtttagctaactggcatgacagagtgtgacatacatgtgctcctggaagaacggtgttgggtgtctgcactcaaaatcttgagcataggcaactggatgaagggctctgtggcattgattttcattgtgtgtgtgttaatatttacatttataattaaataaataatcgaaattatgctgaactgaaa

SEQ ID NO: 335956 - DNA, 442 bp, Homo sapiens
ccccgctcattttccgtgcccccaccaatatccacaaaccaacaaaacctgggtgatcacgagctgcggatacggaagcaacagtagcaggtggcctggccatacagggattccttactcgcagcagagaatgttgctgccactcaaagtcaccaggggctgaagagctcctgtggagacccacatcatctaacaacacacatactcaaaacagggaaatgtgcattttcgggagaggaagagacaaaccttttgtttagctaactggcatgacagagtgtgacatacatgtgctcctggaagaacggtgttgggtgtctgcactcaaaatcttgagcataggcaactggatgaagggctctgtggcattgattttcattgtgtgtgtgttaatatttacatttataattaaataaataatcgaaattatgctgaactgaaa

SEQ ID NO: 335957 - DNA, 678 bp, Homo sapiens
aataagcaacctaaggtactgagggtttaaacgtctttagcaagtttatcaaagtcagtgacctggcagacccaggaattgtaattttgagccatagcccacaccacatattgagaaaactagaagagaatgaacttggccagaggagaatgaaatggcttgatatagatgaagatgcagctgccataagtgatggaaaccacagtaatatgtgaagaacagttgttcatgtattctagaggaaaagaaaggaatatcattatatactgcttatgggattctgtgctgcggagatcattacggaagcaacagtagcaggtggcctggccatacagggattccttactcgcagcagagaatgttgctgccactcaaagtcaccaggggctgaagagctcctgtggagacccacatcatctaacaacacacatactcaaaacagggaaatgtgcattttcgggagaggaagagacaaaccttttgtttagctaactggcatgacagagtgtgacatacatgtgctcctggaagaacggtgttgggtgtctgcactcaaaatcttgagcataggcaactggatgaagggctctgtggcattgattttcattgtgtgtgtgttaatatttacatttataattcgatggcctcgttggcctcagcggtggagctttgcggcag

SEQ ID NO: 335958 - DNA, 688 bp, Homo sapiens
gattttataaatttcacaaatcaggttaaatttaatgtatttgaaatcagtttcaaaaagcattaagcattgtcatttttcagtgctaaacccaagtacagtacatgtccttttatctggtagcttttatttaagacctgatacagacccataagggcatgagtaatgtactgaataagcacatgaataaattaacttctgagcagaattatagtaataggtgcctattataaggtggtgagtgcagagagagttatggtagttataagctgtctgtgggtgaggctaaacagattaacctgactttcaagttaaggcttcctgagagatgggatttcaggatctggctctaaggaagaaagcttggtgaactggtttggtaaggcatccaagaatagagtgtggcttctgggtgtagtctctaaaggagaacacagtaattggatgagagtgtggaaagggtaaatttgctttaggagtggtagggtcaggtacatggaaacaaaagtggttcattggttttaaagtgaaatgtaaaaaaaaaactgtttccactgaagcaaaaaggataaagatttatgtaaacattctttatttgggtagcagcatcttcccatccccctcagtttgttccccactatttctgtatcacctatacatggtacatacttaataaatatttactcgg

SEQ ID NO: 335959 - DNA, 459 bp, Homo sapiens
ggcgctctgaggatccccccgttccccctaaaaatcttacctatcagtatgtaggaataaataacaacaaaagataggtaagatttcagcaggggagatttatttattacgcagtattaaataatataaatgaaatactgtagattagtagaggttactcatgattaggaagacagaacaagtaagatgtcaatttttctgaactgacatgtagatccagtagaattccagtcaaagcataacttccagtcaaatcttttcatggagtatgataaaatgtatcaaagaataaagggccacgaccatccaaggtactttgaagagtatggttattatttatgttcatatgaagaatttgtttgtgtattagggaaggagaggtttgatttgagtctgcagtaactaaatcaatgtggtgatagcacagggttaaacagattgattaacggaacagattag

SEQ ID NO: 335960 - DNA, 275 bp, Homo sapiens
atggaaaggactgaaatcagaaaaagccttaagttctttctgatcctgtcaggtcccttaactctgagctttggcttcctcgcagggaatcgctgcccctgctcaccatcttgggcttctgggggcaacatgtcagaaccattgcctactgatggccagcactgcccgttcctttctttcctggcatgcccatcccacaagtgagagaacctagacccgggaaacttaagcaactggacagcagagctgggacttgaagtcattcatccagctcc

SEQ ID NO: 335961 - DNA, 139 bp, Homo sapiens
tattgtgtatccttacaagaagaccagagcaactttctgctataagttaggcgtcttctccttctcatgcaaataccttgattcccttctcttcccctctaaccacctatgtatcttcaagttgacttttttttttttt

SEQ ID NO: 335962 - DNA, 455 bp, Homo sapiens
ataagttaataaattgcaatactttaagaaagtatcagtaaacaagttaattctgtgtctagttgggagagattatccaagtccgtgttttctggtctcttcctttcattgcctcttgatagtgcctttacaaaggacagggtgcagttttagaagagtttggtgaacttgaaattaattgttagaatgagatttttaaattttgtgcatacatatcaggttccctattgcgtaatatgtaatcagcttctcaattttttatgtaccctaatatttaatcaggttttacatgtgatgcctctatcagcagtcagtagattagtatatttatgtctgtattcaggaatggtataactgagtgttagtatgagtatatttgtatcatgcctaaatttgatatggtcattctctacaattactttccttccacatttcctttctgttgataaagttgg

SEQ ID NO: 335963 - DNA, 976 bp, Homo sapiens
tgaccatgttggcccagctggtctcgaacttctgacctcaagtgatctgccctcctcggcctccccagactgctgggattacaggcgtgagctaccgtgcctggcctgaaatcatgcattatatactctctctctctctctctctttttttttttttttttttggagacagggtctagctgtgttgttcaggctggagggcagtagcgtgatcacacctcactgcagcctcaactttctagattcaggcaatcctcccacctcagcctcctgagtacctggagctacaggcgtgcgctccaacacctggataatttttgtagagatagggtcttgctgtgctgcccaggctggtctcaaactcatgggctcaagcgattgtcccaccttggtctcccaaagtgctggaattataggtgtgagccaccatgaccaactatatatactcttgtttggtctggctactttcactcagcatattttgagattcatctatgttgttgtctatatcaatagttcattcttttcttttgctaagtagtattccattatgtgggtagtactacagactgcctaatccatttattagttgatggacatttggtggctttgagctcctgaactcatgtagtcctcctacctcagcctcccaagtaggtaggaatatagatgtgtgccactatgtctggctatcacataaatgtctttatatggatgtatattcctttgcttctgggtaaatgcctgcaaatgaaatggctgatcatatcataggttgtatgttttaactttttaagaaactgccaaacttttccaaagtggttatattgttcaacattcctaccagcagtgtatggaagtttcagttcctccatatcctcaccaacacttagtatggttagtctttttaattttagaccttctaataggtgtgtactgattcctcattatggttacaatttgcatttctctaatga

SEQ ID NO: 335964 - DNA, 215 bp, Homo sapiens
accttttatgggaaagtgagaataaattctgatccctattatgcagggaaacagaagagagcattgtttttcatcagggtgaagttggggcaaataggaggggtgaatgatgaggcagacagaaagagacagacactccaaactgcttgacaatgagctcatttttaaatgtatgtaataaagttaccacaataatgttgtagctcagtaatgca

SEQ ID NO: 335965 - DNA, 324 bp, Homo sapiens
ctctaaaatggatgaacaaaatgagtttcttacagacatgttaggaggaataatttccttccagattacaaggtgttctgtaaactctcagaggatggttttccaggtaccatgctgagtagttttagccaaaacctgttctgtgctcgaaggaaaccaccaccaagggctgtcagtcaagctgggtaattgtataaatacagtcaagagttaaggaccacataacagtgccatatatggactccactttctcaaaaccctttaaggggatacagtctcatcctactggaaaatgttaggcaaaggatggaaatagttcgtttc

SEQ ID NO: 335966 - DNA, 243 bp, Homo sapiens
gtgactgtttctgacccactctgtggttctcacttatgagtgtctcatccctcaagccatttcctcccccgtccccacatctgtatctatgccaccaatacctggatgagactaagcggtagaccagacccccagtctgggttcaagcactggtgaggcagatggactcagctggaattattttcactttgcttttttttttttcacttgttttttagagatggagtcttgctctttctccca

SEQ ID NO: 335967 - DNA, 225 bp, Homo sapiens
tagctatttcaaagctctagcttctttttgttgcctgttttttagcattatgctcttttgttttaccttaagactctatattgcatgtcttatttgaaatatctaaagtttaaaatgcagcctcataatgtatctatttgcttaatttaaaacatttaagcaaaagtaataggttctgcttcttagctattgatgggataaagaacacaaggacaggtggggaga

SEQ ID NO: 335968 - DNA, 330 bp, Homo sapiens
tgcgaggtgatctagaggatccctcacgcccatgtcacaaggcaaatgggcagggcaaggtcacaatgccagggcgaaattagaattactgatgaggttcactgtcccgctatgcacagattgtcattgataaacatcttaacaggaaacagggttcaagagcagagaaccagtctgcctacaatttcgccaggctggaatttcccaatcctaacaagcctgggggcgctgctggagaccagggcatatttcatcccctatccacaactgcgtaagacagacactcccagagtggccattttagaggcctccccctgggaatgcattctt

SEQ ID NO: 335969 - DNA, 306 bp, Homo sapiens
ctgtgttggatttctaaacctacagaaatgcaagataacaagttcatgttgttctaagccactaaatttgtgttgatttattacagtagccatagaaaactaatacaagaagcaagaggaaatggagggctcacaaaatgtcgtgtttaatcagcttattccccttcatcatgaatgggtgatgaggcaagagccatcaatcacaaaggacatttccgaacaatccaaacagaagtcctgaaggataggagaacctttgcaaatccctaagactgaacaggcctagtgaatgcaggcagagtgacc

SEQ ID NO: 335970 - DNA, 552 bp, Homo sapiens
atagagtgcatggctaattccacatgttcccaggccttatctagaatctaatgctcccaagtaggtaaactgaacaattttcaaaagcctaagaagcagttgatgaccttaaagcatcgaacaaacctaatatctgacctgcctaatttagactaaatgtcttcatttttcccaataatctttaaaactttttatttcccaaagattactaaagttatgtgaactaaaaggcattagtttttattgttctttcaaaatatttgatttaggtgtttatttatttatttgagattactggctttagggtggagtccttggacaaaaaggaccaggaaagcatgcagtttctagggcccaatataataagtgggcacagcagaaagcaacacaggtctccaaaaattaagggtcccatttttataccagatcctgaatcccaaaaagattgagccctgaacaaagagtccggttactttttaagtatattgtgggccggggagatctgcgcagggggaagtatattacagaagagagtacgctggaatggaattg

SEQ ID NO: 335971 - DNA, 252 bp, Homo sapiens
tgtcaaactctatttccctcatcctaaaattcaactcatcattccatctcccaatattttttttatcctaagacatctgctaaattaagattgtttttcagagtcatcttattcaaatgtttgactcaaacttacccaaaagagatcataagaagctgagtcaagtcacatactgaagttaggattccaaatgtcattccccaaagctatcagtctaataactaacaaagaaagaagtgaagttagttttgc

SEQ ID NO: 335972 - DNA, 356 bp, Homo sapiens
tagaaagttaaagtgtctgtttttcccaattaagtttgtttaaatgatttaaatccttgaactacacactttcctaagctgataggaaggaactagtactgagtacattcgctcactggggcataaatctgagctgctggtgaaggttggaaactctggcatgtgaacctatcagaagccttcgtaaggaaatagccactgatgagttcgttgtgacagagggctgcaaaaccctgagacagcctgagttaggaaagaggcttcacctcccaggagaaagcaaaatgatctcatggaaacccaggacttactgataatcacctgtaaatgaagctctgcctacgcgtcactttgca

SEQ ID NO: 335973 - DNA, 558 bp, Homo sapiens
taaaattataacacctaaatgccagtgaggttgtagtgaaatggatagaagcattcgctagtggtgacattatatacttgatatgaccccttttcagtaatacttctcaggactgggaagattgaatgcctcctttgcctcattcatttcattcctaggaatttctccaaggaaatcactgaacagagacaaaacccagtgtgcatcacgatgttcatctcagcattatttttaatagtgacaatttgatagcaaccaagatgtccagcattagaagaccactttaagtaaattgtggataatcaatttgatgatgcagtcattaaaaattatgttgactatgtagatgtgacaaagttacgacagaaagcaaaatacaaattgtatgtgtactatgattgaaattttgtaaaaataagtatgcatgtttgttcaaaaggatgagatggccaagtgggatggttcatgcctgtaatcccaatacatacggaggccaaggcaggaggatgacttgagaccaagctgggcaacagagtgagatcctgtctctacaaaata

SEQ ID NO: 335974 - DNA, 215 bp, Homo sapiens
cacaatggtagaaacctctcctaaggcaatgcttaacagtttgggcttggtgttgtgtgaagtttctaaaaataaatagtgatgcatgtctcctctctctcattgcctcagatttccatttcctaattgaatgattctctttagagaatcaaaatggtcacgtgcaaagttaaccaaggaagaaggggagaaagcaggctaggtaggccagagga

SEQ ID NO: 335975 - DNA, 109 bp, Homo sapiens
atggtatggaatctttctacttgagtcacaagtaaattcactagaatattgaagataatttatttctgaaatctctagtatggggctctaaacatattttgtggcaaaa

SEQ ID NO: 335976 - DNA, 473 bp, Homo sapiens
tgtaagataataacatgtactgaaacactgaaaacacaaactacttgcagagaaaatcagtttgacttaacgaaaactgaggtacagaatattgaggtgaacagaatagttttatttcagtaattcacattctatgcgtatcatataaattgctatgaatgcaatccaaagaagatatttactatgagagtaataatagtaagaggcaataaggtttggaggatggaaattagaatagggcttgagaaacaagcacaggaataaatactatcaccgaaagaaattcctatctggaaagaaagcaagaggatgtaggctcaagcacagtgacaatagtaagaatatgtatctctggcccaaggaatatcccaattaatgccattgtcaggactatgtgcaaataatgaaagcaaaggcatacacagtataagtaacaacaaaataacaacgaatgggaaataaaaaatacatat

SEQ ID NO: 335977 - DNA, 207 bp, Homo sapiens
cagcatctcaccctttgatagtaatcacatcctcttaagagggctttggaaacaattggccttggctagccaatcccaggttttcgcttccatgagggtctccagcttcacacaatattgtgcccatatctgtagcggccttggtttttaattgcaaacaacagcatccacccacatcagtgttggtaaaaaataaattgctttttt

SEQ ID NO: 335978 - DNA, 220 bp, Homo sapiens
tgctgagattttagggggagtcttacaacctaaatgtgaggctcatatgaccccgggggaagtgcagaaacaccatgggaagccaatacttactgaactctgtgaggacttcccatcctgaggatgaaaggcagggcaggggccctggagctcttttataccctagggaccacccacagatggagaatggattaaagtctggccacacccactctttgcc

SEQ ID NO: 335979 - DNA, 130 bp, Homo sapiens
ccgctaacgatgcagccccatcacattgtttcatctatgtttctcagtctaagtgcaagcttcccaccccagtgcactgtcccaccccatggcccccagaataactgaaatattctgcagaaagatgaaa

SEQ ID NO: 335980 - DNA, 324 bp, Homo sapiens
ccttaaccctagtccattaattctcttttatgcttctcctctatgaataacacaaatattattcacccttgtgtcagaaattccagcatcatccttgactcctctttttatctcagatgatactaagttccatcagctacagccctgcaatctgtcccatcagttcatttccatgcattctacagccactgcctaactcaggcccttgccctcagcaagccactggctttactgaagctttcccctagccagtctgaagctgcccttagaaagcaatttgcacataatctcccttgaactttgatgtatatatagacatgtctt

SEQ ID NO: 335981 - DNA, 385 bp, Homo sapiens
cagaagtaaaaacaaactgattattaggaacattgaccataaatccataaaactactagaggtgtgtattggtttggtattgattgttgtaatggagctttgaatttatgaaccatgaagacatttaaggctgggtgtggtggcttacacctgtaatcccagcactttgagaggccaagatgggagtattacttgaggccaggagttggagaacagcctgggcaacacaatgagagacccccatctctacaaagaaaaaaaaaaattaaccacgcatggtagcgtgtacctgtagtctccgctactcaggaggctgaagtggttcacttgaacccaggagttcgacactgcagtgagccatgattgcaccactgcactgcagcct

SEQ ID NO: 335982 - DNA, 249 bp, Homo sapiens
ctccttgacatcacttctggccactcctcatcttgggccccataatgaggtttataactggatagctaagcacagtatagggggatggtgggagtcgagggtgagtctctcctgtcttcctgcagaaccatctaaaacagcccccaagaaagaaatggttacaagagcctatgaagaaacttaagcccatctctataaaaaataaaacattagccaagcatggtggcacacgcctatcgtcctagctac

SEQ ID NO: 335983 - DNA, 242 bp, Homo sapiens
aataatgttaagaaagtagagaggagctttttataacctatgatggcttttgtaggccatgtgaaagagcgtggactctacctcacatttaagaaggattattaaagacctgtaaggaaaatttgacacatctggatttctgttgatcaagatcactttgacaccctggcagagagaagaactggaggaaggagagaatagaaacagacaagtgttgattgagataggaacttcagggcaac

SEQ ID NO: 335984 - DNA, 382 bp, Homo sapiens
atggggtttcaccatcttggccaggttgatccaccttgaactcttgaccttgtgatccgcccgtctcggcctcccaaagtgctgggattacaggcgtgagccaccctccttggtctactcctgtatctttttaatttactttgatgtttattatatatcaagtcctgttctaactaatttaagttcacaattagtttgcaaaaaattaatcaaatcaatgttttgattcatagtcctggaggctaggcatcctcttggctccttcagagggctgtgagggaaggatctgtccaggcctgcctctccttggctgttgactcttgatccctgtatctcttcccatcatcttccctctgtttgtgtctctgtggccaagttcttt

SEQ ID NO: 335985 - DNA, 305 bp, Homo sapiens
caggcgccactgggggctgcgctcgagagacaggtgtggggaccccgcacaggacctgtcttcgctcagatgaacaaacaggaccaagaatgtgtcctaagtgattcaaaactcacatggatacataagttatcaaacacaagtcactggttaatacactctgccagacagctgaagtgcacatctcccatgggcccactgtagcttcgagaagtcactaaggacacctcctggagctggatcaggagtccagagcaggggtccaaaggaagatccccgggaccagagcagcaaagccccaccac

SEQ ID NO: 335986 - DNA, 392 bp, Homo sapiens
cagtgttttgattatgaaaagagttggaaccaggggacatggaaccaggtggcgaatgtcctaaagccagtggtgacatggtggactggtttcctcctgggatctagttcatgccctgcactttaactgtggtgactggctactatagattcacttttttgctcattaaaatgttaaaaaatcaaactgtacataaaaagatttgtgaaaatataaacttgggaattgatctggagagctggcacacagtcctccccaccccctgccttagcaatgaggtcatttacatttcatcagctgtgcagcatccccaagatccgatttatgtggcagtagttgaagttgcaccgaggctggttgtctaaaagagcttgtgtaggcaagagaaacgg

SEQ ID NO: 335987 - DNA, 217 bp, Homo sapiens
ccatctgaagagaataattccttaacatcagatacccagtcaatgttcaaactgccccaattatcatataagttttttagcaactggtttgttcaaatcaccatctagaattatttcagagggaaataacggtttccttgtctcctgctctgtggtcttttaccccttcaatttcatatacttaccttcttaatttttaagtgtaggcaaaagagca

SEQ ID NO: 335988 - DNA, 485 bp, Homo sapiens
agcagcagctatctcatatttctcgtttccttgttagaaaatgaggaattttccagtaatctcattttccagatataaatagtgtcagttatttatatggtgtcgtctttcgaagcactgtcaaatacattatatccgtaaggcaggaaatgacaggtattgggggaattgtcccatgggtgatgagtggaagagctgggaacagaatccaagtcacttgactcccagtccggtgtttgaaactcatctctcaggtagcagtgtggtgtccacaaaagaacaacagactaggaacctggaggttcttaagccctgaccctaaaattaactagctctatgcccttgaacattaattttacctgggccatagcagataccttacaggagaaaatttaggaattaatctaaattaaggtcagtgagctgctcaaagtcaaatgtttactatagggctagaataagtgttttttttttttttttttttt

SEQ ID NO: 335989 - DNA, 148 bp, Homo sapiens
ggtggtggggtcagggagggcttatagggtatgttaaatcagcagaataattttatttatttatttggagatggagtttcactcttttgcctaagctggagtgaagtagcgtgatcagagatggagtttcactcttttgcctaagctg

SEQ ID NO: 335990 - DNA, 697 bp, Homo sapiens
aagctgcacctgcatttgtgcctaaagagtggggatggggaagctgcacctgcatttgtgccctaagagtggggatggggaagctgcacctgcatttgtgccctaagagtggggatggggaagctacacctgcatttgtgcctaaagagtgggcatggggaagctacacctgcatttgtgccctaagagtggggatggggaaaccgaagttggagagaaaacaaccgcctgtgcccggccttcagaatgagatgtggggtcctgagcgtgacctgtgggtgggtaagtaccacccacacaaggaggatcggaatgagatgcgggtcctgagcgtgacctgtgggtgggtaaatgccacccacacaaggaggagggtcctgagggttcctggccactgaccactggccactgacacccggtgccactgtgatcagtccctgctgtgccataaaccacactcaagcccctgggggccccacagccctcagcattgctcgggtgtggaaatgagggggtcacaagggaacctcctctagaaacaggaacctccaaactgggatggccctggaaacaatgggcatcacctgcatagcctgaggccaccaccagcgcctccctggccttctcttcctacagcaggtccctgcccaacagctgtggctctgacctctcccttccccttctcagtcccatcctg

SEQ ID NO: 335991 - DNA, 232 bp, Homo sapiens
gcctattttttaaagttgtctgaagacttggctcactgtccaatcttgccaagtttctcctattcctaattttatgctgtttatcatctgggaatgcagaaaacaaagtcatagtaacccacatgtgtttccctaacatggacctgaacctaagaatgactgtgccccctactctggaagtatctgtgctaagaggaaggaagacaaatacacagctatttccagcctgctg

SEQ ID NO: 335992 - DNA, 538 bp, Homo sapiens
tgatggatggtaccttcgttattctccatctgtggtgacggcttcgtgatatatccatagtgtcaaagcttctcaaacttcattctctagcatgtgcagtttgctgtatgtcaatcatagctcagtagaactgttaacaaaacaaaaaggctctgccctgggagccttacaatcccacaaggccagaaagaaaccaggtaattacatagacaggaggcagactcacttgctgtagctgaggtgagggtaccttccagaaccacaggaacacaggaaggcagggctcctgagggctgcagaggagaagtcattctctcctcacaggccctttaatgcctcagtttccccaagtgagcagttagaaggaatagggagtctcataccctaagactggtgtggaaagcgtttggagttctagagcttcggggcagctgtgaggaggccttctaggggggatgggtcaggggcatatgtgggacaggcactctgacctcctctgcccacccctgagaaagctgaatgaggcaagagatagcga

SEQ ID NO: 335993 - DNA, 319 bp, Homo sapiens
ttacatcttggcctgctcagaaaaaaggaagtagtttcaatgttagtgcagcaaaaatgcctaaaggtgactgtgctagtctgttctcatgctgctaataaagacatacctaagactgggtaatttataaaggaaagcggtttaattgactcacagttccacatggctagggaggcctcacaatcatggcggaagttgaaggaggagcaaagctactggcagcaggcacgagaatgtgtgcaggggaactgccctttatgaaatcatcagatctcatgagacttattcactatcatgagaattgcatgggaaaaacatg

SEQ ID NO: 335994 - DNA, 190 bp, Homo sapiens
ctgtgtcaccaagtaagatggaatgaatggggcctagactgcggtctcctggccagcctcctgctgtcctccacagtaggctctccatctgtgcagagagcagtgctggctgggcaggcagcaggcacccactggcctggccacttacctgtagggagaagggcccagcctctctggtgcacagcggcca

SEQ ID NO: 335995 - DNA, 247 bp, Homo sapiens
tggggcgatctcactcactgcaacctccacctcccaaggtcaaccgattcccctgcttcagcgtcccaagtagctgggactacaggtgtgcaccaccatgcccagctaattacaaaaatagtttttaagctcatttatttcacatatcatttcacatgactgtaaattttttagatttggtcatttattactacagtgttaggtgctttagtgttaggtagctattgatagcagagatgatgaggaa

SEQ ID NO: 335996 - DNA, 4394 bp, Homo sapiens
cagggcccagaaggcagctgtgcagagtcgagagctggatgctcttttgatacagaaactaatggaactggagaccttctttgccaaggaagaggagcaggaacaatcatcaggctgttgagaagcgattcagtttgagggtctcaattttagggtttttttgttttgttttgtttttgggtttttttttttttttggacctccttggaaaaggttgcctaattttgccctaccgccaaaccactcaaaaatgcacagtccatgaatttttacctatttcaaggtgcaacctttttagaaactggtgaaggagggtcctctacttttactgctgagtatagaacctcaggaatgctccctttctcctggaaatggacctgaacgacatccagccacctcctcagtctctgccatccacaggaggaagcagcagcctatcttcagtaacactaggattccaaggacacacaggatttgcacgtccatatgaaagttccgctttgtttacggtggtgctagaccaagattattagaaacgtggcctagggagggggacctggcgtcctgtcctgtgtggtctcactggctcatttcagtagttgaggaaagatgagctgttgtgttttcttatcttttgtctgcccaggacctattgatgtgagtgtatgtgagagtgtttgtgtgtgtgtggctttttcccatcgttttctcccctctgtgactgggtcactagtgccagaggagcccgtccaggccccattcgaagtaagttgcactttttaatgttgtggtgtggattattttcatttgttttattttcttttttgttgttgtttttgtactattattgctgcatgtgtggagcctttaaatgtgattttaaaacatttttttaaggagaaaaacaatacatgtcttaagaatacatgataggcatttgacccagttgatcgctgcatggaagagacatttttcctattcatgtgtttcaggcaatcccttccccatctccagcttctagtgtaactcattagagggagcactttttttcatctgggttctcattcttgcccaccaaatacatgtatttattttagtgatttaagtaagagcaggtttctctcccgatcattgaaaaactactatggttgggtgtggtcttaatggtttttatctgaaatggtgttaggtaacaaaattgagtacaacggcttgggcagtgatacaggctgacccacagtatttgtggctttccaggcagcccgcttcaagtgtggggagagagtcggggtcatgtttcagacccagagatgtgttcctgcagtgggatctcaaaaatccccagccagccttctttgagggccacctcattgtactctgggctcctacgtcacatctaccggaactgtcaaatgctggagttagccgagtttctgggtttgtgcctgcaggagtctgtgggcagagggatgctgtgggtcagcagcctcgaggtcttgttccttttccactgaagtcctgtgtgtccatatcctgctccccttcccctccttctctaggggtttctctttctctctcaaaacaagagtttagagaattaacattccatggctagtgagtgggatgcaaaagtcatcgtcaggacaccagcatcacctcttcatatcctcctgggagccactggcatggagcagccgccgatgggaaccgtcagagttctagggacatttccaagtcagtctattagagaagagtgagtggcacgtcctggaatgttggccaactctcctaggtttcttttgcttccccatttgctagtggatggggagatgggttgggggtggggggtctctatgtgccttgcttttgcaggttgacagtctatgccacactggagcagaaaaactgacatgagccagagggaaaagtgtgccacggctatgttctaggcccactgcctcagacatagcattgagacgagtgaaatacacacttggtcatccacggaggcttccaaggccatggccaaatacagttagaagagagccaggcttccgtaccagctctgaatgatgctaaccagattctgtcattctacatccactttgcccagactgtatagacacgacctatgtttcacctcaatacctctcccttcctgggacagggttcttagacactaaatgcttctctctgacttttttgcttaagggagtgggatgagtagtacattttgcccttgtccaggcatgtttaaggagctcctactggacaggttgcagactagcagtgagtcaacagagccctgtttgccagctctgttgccagtgtagatgcagtgatgtggcggctatgtttcccagagacaacagtgggcacagctatagtgtcaccaacatggcagagatagtttcaactgtgcctgttacaggtgtggcactcgaaggaccagaagcagcggtttggaacatgggtaactgggagcagaggactggaagaaacagagctgggctccttccctgtcctgacaatgtaggagaggagttgttgtgaggccagccctgcccgtcgttgaaattctggacctaccctctagctaggtcccttcccctgctccaaagttgagaagggggccccactgcaaacttgaaattacttacctgaaggtgatgtatatacctaggctccagctgcgctcagccacacctgtcttaacattcagtttcggcactgagccagctgcagtgttgtcaggggtccccaggcccgtggtccctaaccacgatgggacatggtaatcggctgctggcacaccacctgcccagagctacaggaggtctggttctggggtggagttggtacagtttctgagtatgggaacttccctccccaagtggtgggaagttacagttaactacagcttactcaactatcacttccagaggtttagtgtttttaatatgggaaagaggagaaatctcaggtctaatcagggttctgcccatcagcttttcactgaaactttcaactgtgttttgttttttgtttttttttccatctttcagtttctagctgtgtttgccttctccctccgcgttccctcctctttttttgcttttggtctcctttccagcttcatgtctccatgagttcagctgtacctcatctcctgttaaagcagatcatgtccactttttcttactgaccttactctaagctacagtagctgagggaggtacggtgaagacatgtagcgtttgccttattcggagcctgaggagcccagaaacccatgctgtgaatcccaaaactcagcgctcctcaagagctgtgaaaatcatgatactttgtcacaattttgcctgaaagggtctttggcacgggctccagagccaacctgaggtccattccagatcccactatctgggcgtgagacctcccccgtggctccttccttgcccactgagccaagagcagcagggagcgtacaggacgggagcagcagatccaaggccgcggtgcagccaatgaatgcacggccgtcgctccgtctccaggctggaattccgtctcataatcaatgccatgtacattaagatctgcgaaagaccaacttttaggcagtgatacttttctcccattccctggggtggggggagtatgcagttggtgctttctgtaattcccttgttctgttttgtttctgtaagcttttcccctggtgtcatggaaaggacttcttaaataaccacattgtgggtggctgtatccaaagtttaaataattggccagaagtgcagagtatcctttcctggattcgtgtcagaaaagggctccttgccacaactgaacttactgtataaaaacctggctagggagatttaattttactaaaattacagtttaatgttaccgtctagccacaaatcaagcagcaaaagctattttgatgatgaaagggggtccccgttgagctggccatctagtgcagtgtgctctcagattccatgtttgttgattgtgtgtcttcacaagcccctctctggtgctgaattggatttgaattcttggtgagaggcctcagcatctccttgggctggtctgggccagtaaaaatagctgcctgacatgtttatatattatcatggtcagtagttcaatgaaatttgtacatttttggtaacattggtatacatgatgcccctgcagttccttttctgtttggtagtttgtgactctaagatttccactgttatgtgtgttaatttatgaaaataaatttttttgaaaacctggtttaaacgctttattgtgcccaaaaaaaggcccatggaatgaagggaagagccgcgcagccctgagcccggagcgatggtttgtcgcgcacccaaagg

SEQ ID NO: 335997 - DNA, 2064 bp, Homo sapiens
cagggcccagaaggcagctgtgcagagtcgagagctggatgctcttttgatacagaaactaatggaactggagaccttctttgccaaggaagaggagcaggaacaatcatcaggctgttgagaagcgattcagtttgagggtctcaattttagggtttttttgttttgttttgtttttgggtttttttttttttttggacctccttggaaaaggttgcctaattttgccctaccgccaaaccactcaaaaatgcacagtccatgaatttttacctatttcaaggtgcaacctttttagaaactggtgaaggagggtcctctacttttactgctgagtatagaacctcaggaatgctccctttctcctggaaatggacctgaacgacatccagccacctcctcagtctctgccatccacaggaggaagcagcagcctatcttcagtaacactaggattccaaggacacacaggatttgcacgtccatatgaaagttccgctttgtttacggtggtgctagaccaagattattagaaacgtggcctagggagggggacctggcgtcctgtcctgtgtggtctcactggctcatttcagtagttgaggaaagatgagctgttgtgttttcttatcttttgtctgcccaggacctattgatgtgagtgtatgtgagagtgtttgtgtgtgtgtggctttttcccatcgttttctcccctctgtgactgggtcactagtgccagaggagcccgtccaggccccattcgaagtaagttgcactttttaatgttgtggtgtggattattttcatttgttttattttcttttttgttgttgtttttgtactattattgctgcatgtgtggagcctttaaatgtgattttaaaacatttttttaaggagaaaaacaatacatgtcttaagaatacatgataggcatttgacccagttgatcgctgcatggaagagacatttttcctattcatgtgtttcaggcaatcccttccccatctccagcttctagtgtaactcattagagggagcactttttttcatctgggttctcattcttgcccaccaaatacatgtatttattttagtgatttaagtaagagcaggtttctctcccgatcattgaaaaactactatggttgggtgtggtcttaatggtttttatctgaaatggtgttaggtaacaaaattgagtacaacggcttgggcagtgatacaggctgacccacagtatttgtggctttccaggcagcccgcttcaagtgtggggagagagtcggggtcatgtttcagacccagagatgtgttcctgcagtgggatctcaaaaatccccagccagccttctttgagggccacctcattgtactctgggctcctacgtcacatctaccggaactgtcaaatgctggagttagccgagtttctgggtttgtgcctgcaggagtctgtgggcagagggatgctgtgggtcagcagcctcgaggtcttgttccttttccactgaagtcctgtgtgtccatatcctgctccccttcccctccttctctaggggtttctctttctctctcaaaacaagagtttagagaattaacattccatggctagtgagtgggatgcaaaagtcatcgtcaggacaccagcatcacctcttcatatcctcagattccatgtttgttgattgtgtgtcttcacaagcccctctctggtgctgaattggatttgaattcttggtgagaggcctcagcatctccttgggctggtctgggccagtaaaaatagctgcctgacatgtttatatattatcatggtcagtagttcaatgaaatttgtacatttttggtaacattggtatacatgatgcccctgcagttccttttctgtttggtagtttgtgactctaagatttccactgttatgtgtgttaatttatgaaaataaatttttttgaaaacctggtttaaacgctttattgtgcccaaaaaaaggcccatggaatgaagggaagagccgcgcagccctgagcccggagcgatggtttgtcgcgcacccaaagg

SEQ ID NO: 335998 - DNA, 598 bp, Homo sapiens
ggtaggggaagctttggaaacatccactagtggccttatttatgactcaggacacctgccaggtcactagaacacagctgaggaagctgtcggccagacgtccagaagcatcaacctggtggctgggctgtggggggacctctctggacaggcagacaaggtgtcggaggaaggggctgacactcactcagtgtctgtcatgcactgagggcacaaagggcaggatggagagctggcccacgccacctgtggaatcttccaggtgtgggggcagatggggaagcaagggggcttgaagacacatgcgctcattaaatgtccttaaatcccaagaagaagaacaaggacacatccacaggggcagggctgaaagtctgatgcatggtgttttggggtctgctcctgctgcaacagctacagtggctccctcttacctttctcttccctccattctgttgtgaaaatgttcaaacacatggtcaagttgaaagcattttacagggaacacattcagccatcacctagattctaccactaacaccaagctacacctgctttatcacctcaccgtccatctatccctccttcgcctggccat

SEQ ID NO: 335999 - DNA, 517 bp, Homo sapiens
tacctaactccaagttttatttgcctttttacgatcctggaatctcttataggtttgggtttcatgaaagtccttgggttttagctttcaggaagtagcatgcattgggaaaccttcttaagcacatgctccaggtcccttgaccaggattaactcagtccatgtttggggtctctcagaaaatgctcagagttcctgcgatgggagctttgcagctgctctggttaaggagcttgccagatgtgtggaacagaatcaaaatccccggaatgtcgtccctgttggtgtcatccatcactgtggcacagacggctcctctgagggcctcctccaaaccccagccctgtcggcctgcatttgacacttccaatctggctggcggggcaagcccagcagacactctcgctggcaggcagtaggacagctgatggatgggctcagcctgcattgctgggcagagccaagccagctttgaagaggcatttccacaggcctgctggctgtcgtggcacctgct

SEQ ID NO: 336000 - DNA, 961 bp, Homo sapiens
tggaaacgactccaaaaggaccccctaaaactatacaaatacatggaaattaaataatttgctcttgaatgatgtttgggtcaacaatgaaatcaggatggaaatttaaaaattctttgagttgaacaatgacagtgaaacaacttatcaaaacctctgggatacagcaaaagtggtgctaagaggaaagtttaaagcattaaatgcttacatcaaaaagtctgaaagagcacaagtaggcaatttaacatcatacttcacggaactagagaaacaaaaacaaaccaaatccaaactcagcagaaaaaaagtaaataacaaagatcagagcagaactaaatgaaattaaaattaaaaacacaaaacataaatgaaacaaaaagcagtttctttgaaaagataaaacacaattgatagaccattactgagattaaccaagaagatagaagatccaaataagctcaattagaaatgaaactggagatattacaaccaataccccagaaatacaaaagatcattcaaggctactatgaacacttttatgcacacaaattagaaaatctggaagagatggataaattcctcccatattaaatcacgaaaaaatagaaactctgaacagaccaataattagcaagattgaaacaataataaaaaaaattgccaacaaaaaaatgtccagaaccagatggactgacaggtgaattctattagacattcaaagaagaattgataccaatcttactgaaactattccaaaagatagaaaaagagggactcctccataaatcattctatgaagccagtatcatcctaattccaaaactgggaaaggacataacaataaaagaaaactacagactaagatccctgatgaacacagatgcaaaaatactcaacaaaatactagctgaatccaacagcatatcaaaaaggtaatacaataggatcaagtgggt

SEQ ID NO: 336001 - DNA, 378 bp, Homo sapiens
ggttttatggtagccacttcattatctttcatgatcctgcaggttaactgggctcaactgctcagtcctgctgcacgtgatactgacaggaactgcaaccttcaaggacttggctggctagagtgtctggcaccttggcagggacagctggaaggctgggctctgctgagatggctggacctctttcctctccttatcaactcatggcatttcctccatgtggcttctccacacagtctagacagcagcatagctatacttgatgtatggcagctttcttcccaaaagtgcaaaagcagtttccagacctcaataattggcccagaatcagcatactttctcttctgccacatcctgtttattaaaatgagtcacagg

SEQ ID NO: 336002 - DNA, 118 bp, Homo sapiens
cactcttagctgtttggaaaaaggcatgtgacctaggctcaatcaattagatgctcttgagtagacctttgattcttgagagagagagatgccaagttgctggaagagtcagagatat

SEQ ID NO: 336003 - DNA, 609 bp, Homo sapiens
gaggatgatgtgatcagatttatgattaaaaacaatcactctgactgccaagtgaagatcagactatgagggtgaagaagccaggctggaaacaggacttggtggtcgtgggggaagggtgaagagtagctgggccaggagatgacctgaagtcagatagatgtggcctgcaggtgatgcaggagtccatgatgacgcctaagtttctgaccaagcagctaagtggatggtggagtcatttactgaaacagggaaaagggggaggaagggtgtgggggagaaggccaaggccacattttggacatgtgaagtgtgagatgctcgtgggatatccagcaaaggtgaaaggtaggtggttggacaggagtctggagctcagggagccatcagcatggtgacccatgtggacaagcttaactcggtgatttcactgaaagtcctgggactgggcggcgtgattgcccagggcatgggttctcagtggtatcatactgccccctaggggctaccagaaactgcagtctatttttggtggtcagtaatacggtgctactggcattggaaggaagggatcagggagggactctagatgtcctgcagtctcctacg

SEQ ID NO: 336004 - DNA, 104 bp, Homo sapiens
ccaccggcacttccaggagcttgataactagagaggcattgcaacgcaaagtggggaaactgaggcccagggagagggctgcttgccaaggtcagacagggaag

SEQ ID NO: 336005 - DNA, 508 bp, Homo sapiens
cttcccccttcactcagctctcttctctctcctgctgccctgtgaggtgccttctgccatgattgtttcctgaggcctccccaggttgtggaactgtgagtcctttaaacttcttttctttataaattactcagtctcaggtgtgtcttcatagcagcatgaggacggactaatacagtaaattggtactgcagagaatggggtgctgctataaagatacccaaaaatgtgaaagcaactttggaactgggtaacaggcagaggttggaacagtttggaggactcagaagaagacaggaaaatatgggaaagtatggaacctttctagagacttgttgaatggttttggccaaaaggctgatagtgatatggacaatgaagtccaggctaaggtggtcttagatggagatgaggaacttgttgagaactggagtaaaggtgactcttgctatgatttagcaaagagactggtggcattttgctcctgctctagagatctgtgggactg

SEQ ID NO: 336006 - DNA, 483 bp, Homo sapiens
gcccctgggttgccatgaggatcatgtgaggtgacaggaagaggtttgaggcagcacaaagctctataatcccccttgctcttgttatctgttaaacacactgtttggtgaaatgcacacttaggcaacgaggctcttcggcagagaactgatctctgagtcaggcttcatcaggccctctggttggttcagcaaatggatctaggcactgattccttccacctcctgaacccagacccatctgctcatttgttgataggacacatctacctgagtgtcctcacatacaaggtgcctgaagctgaagctgtcagccatgcacctgcacccaggtggtacacgccctgagctcaccagtctggccagtggcacccatctgcccagtcacccgagccaggaacctggaatcggtcttacccctcccttctcttcacttcccacatccactcaccacggtctgccgctgccagtctcccctctctg

SEQ ID NO: 336007 - DNA, 209 bp, Homo sapiens
taactacattacctttatattaataacagtcagaaaggaaaactatgaacatggccaaacgtatgccctaaactttagaaaagcagatttcaaaaatgtttagggaaaaaaatagatatgctgtatctaaagtaaaagtatgaattccttattcaactctaatctgcttgaaattgtatcaatgactagataaacacaaagcaaagata

SEQ ID NO: 336008 - DNA, 1229 bp, Homo sapiens
atgttccctcagtctaccactgtaaaaacagagtctaatatgggaaaataaatatgaaaatagcatgaaatgctgtttcccagattgcaagataagaccagaacttggtccaagagccagccacccagggagactcctgctttccacagaggagaccaggttcctgtcgtgctggttgttcgtgtcaggcagtcctgcaaactttgagtctgcgcagcgtgccagaatagcttgtgtttcagtcctgtgtcaagaagcaggtgaaaccaaaggttggagaaaagcatcacacgtcgacttacactttctcatttcccacgttccagtctcctgggaagggcactctttcgccacgttttcctgcctcttggcaaatattaactctttgcagatcactaaagcaacagtaaagactttgagaaaatctagacacattattggatcaatgagttatttaacctagtgtctagtgattatctaacctggaaataaattcccaaggaaagtgataataatttcataatcatctgcaatttctggggaacagtggtactgaataataagacatcttttaaaaatatacacaatattaaaaacctgttcttattttactttagatgagggaggaaaatcccccaaatttctaggtactttcatatatatacttgccatgcactaaacactgcattgcttggaaaaatatttcacaccctctttaaaaatgtacaatttaagatggcagttatgcttgtaacagacagcacttcagtaatccaagaagtttcttcatttatacattttatctcaactctttctagcattagtgcacatggtagtttttctaattaaattgtattcaaggtagaaatgatcatgtgagaaagatatatgattgagctactactgtcacctcttacagttactagtgttagctaatagaaactttcatatatacacatagaaaagaattattacattttacattgaaaaatgtaatatatggcccatgtagtgtatagaaaaatctgtagtttattggttcatcaactatgtattgtgcacctacctatgggtgtcaggtacaatgttaggtactgtagaatcaaatgtaaataagagacagtcccagccctcagggagccgagaacctaatagtgaatctgtttgtacagacatcttcatgtttcagaacttttaaaacaaaacaaaataatgtaatctatcatctt

SEQ ID NO: 336009 - DNA, 792 bp, Homo sapiens
tgacacccatcgagacccaagtttcagaatttgctgcagccttgctgccaaatcacagtaaaagctgaaaaggcttttgtggttagttacgtgtgatacaagaaatcgatgtgtctgagagaagtaggatttctctttttgagggggaaaaatacagcaaggggaaatgttttattaacaataaatatgcggcttaccatatctgtagggcacagatttggttagtagtattttgaaggcaggataaaggaagatcctaaaatctctgtgctgtgtagcttccattcgagctgcacatgttaaaaacattctaggatccacacagtttaaacaaggtggctggcttaggaaatgcttctccccattccttggcatccccacaaccctattctcctactttctcttatgtatctggactggcttttaaaagatatttagtgaaatttaattttctagggaaactccactttgtcaaaagtgtagtattcctcaaggatagctttgctggtcggcaaatctcagttgagtgtatttgtggtttaaaaaaaattctttctgaatagaaatacaaagagtgataatgtttaacattttattttttaaaaagctttacgctgtgtaaattgtgggttgacttcatgtttctaaactttgtcttttagaatgactctcttgggtaaattattagcagacactctcgtgttgacatgtccattttcctttccattaagctgtctccattgcagttctgttgatatggctttatatagttttcctgagcttttttttttt

SEQ ID NO: 336010 - DNA, 2099 bp, Homo sapiens
cgacgctccaggccgtcccgcccagcgcagctgcacccaatcacaatgctcagatcgggaggtggagccaatcaggtccaaccaagaggaggggacaccggcactccactagcaggaaaacgggccgagggaccgcaagcagggggtgcctagtcctcgtcccccaaagaccaatcgtaagccagatacaggcgagtgactgtcaagaaggccaattagagcctccgaagggaatctggacctgcctcttctctgagggacggctctacctaccaatagcatgggcgagaaggcggtccctttgctaaggaggaggcgggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcaggacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtggtgggtaccaccagcagccgggcctgtgactgtgttgaggtctatctgcagtctagtgggcagcgggtcttcaagatgacattccaccactcaatgaccttcaagcagatcgtgctggttggtcaggagacccagcgggctctactgctcctcacagaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagatcctattctgtgctcttggctacaaccaccttggcctggtggatgaatttggccgaatcttcatgcaaggaaataacagatacgggcagctaggaacaggggacaaaatggaccgaggggaacccacacagggaccctggccgtgtgtccccaggtttgttacctgcagcggcccatcaccctgtggtgcggcctcaaccactccctggtgctgagccagagctcagagttcagcaaggagctgctgggctgcggctgtggggctgggggccgcctcccaggctggcccaaggggagtgcctccttcgtcaagctccaagtcaaggtccctctgtgtgcctgtgccctctgtgccaccagggagtgcctatacatcctgtccagccacgacattgagcagcacgccccctatcgccacctgccagccagcagggtggtggggactcctgagcccagcctgggggccagagcaccccaggaccccggggggatggcccaggcctgcgaggagtacctcagccagatccacagttgccaaacgttgcaggaccgcacggagaagatgaaggagatcgtagggtggatgcccctgatggccgcacagaaggacttcttctgggaggccctggacatgctgcagagggctgaaggaggcgggggtggtgtagggcccccagcccctgagacctaatccccctcatgctagcctagtccctggaggagggagtccggccccaggccagggactaaggagcaatgaccattgtgcacatgcgtgtgggaaggggttgctagggggtggggacggctaaccagggtaagaatgttcagggggctgcccaggaggggcccccaacctgactatcatggacaagagatttgatggatagaataaaaggctgcagcga

SEQ ID NO: 336011 - DNA, 1800 bp, Homo sapiens
cgacgctccaggccgtcccgcccagcgcagctgcacccaatcacaatgctcagatcgggaggtggagccaatcaggtccaaccaagaggaggggacaccggcactccactagcaggaaaacgggccgagggaccgcaagcagggggtgcctagtcctcgtcccccaaagaccaatcgtaagccagatacaggcgagtgactgtcaagaaggccaattagagcctccgaagggaatctggacctgcctcttctctgagggacggctctacctaccaatagcatgggcgagaaggcggtccctttgctaaggaggaggcggacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtgaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagaccaggggggagtgtattttgaggtgcataccccaggggtgtatcgcgatctctttgggacccttcaagcctttgaccccctggaccagcagatgccgcttgctctctcactgcctgccaagatcctattctgtgctcttggctacaaccaccttggcctggtggatgaatttggccgaatcttcatgcaaggaaataacagatacgggcagctaggaacaggggacaaaatggaccgaggggaacccacacaggtttgttacctgcagcggcccatcaccctgtggtgcggcctcaaccactccctggtgctgagccagagctcagagttcagcaaggagctgctgggctgcggctgtggggctgggggccgcctcccaggctggcccaaggggagtgcctccttcgtcaagctccaagtcaaggtccctctgtgtgcctgtgccctctgtgccaccagggagtgcctatacatcctgtccagccacgacattgagcagcacgccccctatcgccacctgccagccagcagggtggtggggactcctgagcccagcctgggggccagagcaccccaggaccccggggggatggcccaggcctgcgaggagtacctcagccagatccacagttgccaaacgttgcaggaccgcacggagaagatgaaggagatcgtagggtggatgcccctgatggccgcacagaaggacttcttctgggaggccctggacatgctgcagagggctgaaggaggcgggggtggtgtagggcccccagcccctgagacctaatccccctcatgctagcctagtccctggaggagggagtccggccccaggccagggactaaggagcaatgaccattgtgcacatgcgtgtgggaaggggttgctagggggtggggacggctaaccagggtaagaatgttcagggggctgcccaggaggggcccccaacctgactatcatggacaagagatttgatggatagaataaaaggctgcagcga

SEQ ID NO: 336012 - DNA, 260 bp, Homo sapiens
cccaggggtgtatcgcgatctctttgggacccttcaagcctttgaccccctggaccagcagatgccgcttgctctctcactgcctgccaaggtaggctcctggagggacggggcaaaccagaggggtggcgctgtagggattggaaggtctgaagtattataggaatcagattattgatccagaggggcaggggatccccagggagaggtatgccaaaagagatcagctgggggctcggtgcggagggaggctgaggagg

SEQ ID NO: 336013 - DNA, 2240 bp, Homo sapiens
cgacgctccaggccgtcccgcccagcgcagctgcacccaatcacaatgctcagatcgggaggtggagccaatcaggtccaaccaagaggaggggacaccggcactccactagcaggaaaacgggccgagggaccgcaagcagggggtgcctagtcctcgtcccccaaagaccaatcgtaagccagatacaggcgagtgactgtcaagaaggccaattagagcctccgaagggaatctggacctgcctcttctctgagggacggctctacctaccaatagcatgggcgagaaggcggtccctttgctaaggaggaggcgggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcagggttctggagtccggccctggaagagagctgccattctgaactacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtggtgggtaccaccagcagccgggcctgtgactgtgttgaggtctatctgcagtctagtgggcagcgggtcttcaagatgacattccaccactcaatgaccttcaagcagatcgtgctggttggtcaggagacccagcgggctctactgctcctcacagaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagaccaggggggagtgtattttgaggtgcataccccaggggtgtatcgcgatctctttgggacccttcaagcctttgaccccctggaccagcagatgccgcttgctctctcactgcctgccaagatcctattctgtgctcttggctacaaccaccttggcctggtggatgaatttggccgaatcttcatgcaaggaaataacagatacgggcagctaggaacaggggacaaaatggaccgaggggaacccacacaggtttgttacctgcagcggcccatcaccctgtggtgcggcctcaaccactccctggtgctgagccagagctcagagttcagcaaggagctgctgggctgcggctgtggggctgggggccgcctcccaggctggcccaaggggagtgcctccttcgtcaagctccaagtcaaggtccctctgtgtgcctgtgccctctgtgccaccagggagtgcctatacatcctgtccagccacgacattgagcagcacgccccctatcgccacctgccagccagcagggtggtggggactcctgagcccagcctgggggccagagcaccccaggaccccggggggatggcccaggcctgcgaggagtacctcagccagatccacagttgccaaacgttgcaggaccgcacggagaagatgaaggagatcgtagggtggatgcccctgatggccgcacagaaggacttcttctgggaggccctggacatgctgcagagggctgaaggaggcgggggtggtgtagggcccccagcccctgagacctaatccccctcatgctagcctagtccctggaggagggagtccggccccaggccagggactaaggagcaatgaccattgtgcacatgcgtgtgggaaggggttgctagggggtggggacggctaaccagggtaagaatgttcagggggctgcccaggaggggcccccaacctgactatcatggacaagagatttgatggatagaataaaaggctgcagcga

SEQ ID NO: 336014 - DNA, 2108 bp, Homo sapiens
ggcctcagaggtcccccaagcctaggctggggacatggtgtgggaaagccagcaggaacgggggggccaagggcctaggagacaggagggcaggagcagggagggggcaatcaggatggtcaggggaagccagagacggaagctgcaaaaattcaccaggctgtgtggacgggaggaggggctccgggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcagggttctggagtccggccctggaagagagctgccattctgaactacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtggtgggtaccaccagcagccgggcctgtgactgtgttgaggtctatctgcagtctagtgggcagcgggtcttcaagatgacattccaccactcaatgaccttcaagcagatcgtgctggttggtcaggagacccagcgggctctactgctcctcacagaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagaccaggggggagtgtattttgaggtgcataccccaggggtgtatcgcgatctctttgggacccttcaagcctttgaccccctggaccagcagatgccgcttgctctctcactgcctgccaagatcctattctgtgctcttggctacaaccaccttggcctggtggatgaatttggccgaatcttcatgcaaggaaataacagatacgggcagctaggaacaggggacaaaatggaccgaggggaacccacacaggtttgttacctgcagcggcccatcaccctgtggtgcggcctcaaccactccctggtgctgagccagagctcagagttcagcaaggagctgctgggctgcggctgtggggctgggggccgcctcccaggctggcccaaggggagtgcctccttcgtcaagctccaagtcaaggtccctctgtgtgcctgtgccctctgtgccaccagggagtgcctatacatcctgtccagccacgacattgagcagcacgccccctatcgccacctgccagccagcagggtggtggggactcctgagcccagcctgggggccagagcaccccaggaccccggggggatggcccaggcctgcgaggagtacctcagccagatccacagttgccaaacgttgcaggaccgcacggagaagatgaaggagatcgtagggtggatgcccctgatggccgcacagaaggacttcttctgggaggccctggacatgctgcagagggctgaaggaggcgggggtggtgtagggcccccagcccctgagacctaatccccctcatgctagcctagtccctggaggagggagtccggccccaggccagggactaaggagcaatgaccattgtgcacatgcgtgtgggaaggggttgctagggggtggggacggctaaccagggtaagaatgttcagggggctgcccaggaggggcccccaacctgactatcatggacaagagatttgatggatagaataaaaggctgcagcga

SEQ ID NO: 336015 - DNA, 466 bp, Homo sapiens
gttggaagcagggagcccaacaaaaggttattactgtccaggagagagacaatatgacttgggctatgggaaccgagtgaatgcagtgagaaggagatcagagtcggaaaatgctttggaggatgaacaagtgagatctgctggtgagttagaaatgaagtgcgacagaaagggaggagtcgatgattcatagagcactgactgatctccaatttccaggttacaaagatgtggaatttcacacacaactcaattattatttggagaagaaattaatctttctgtggtaattcagaaggtatataaagaggagttctcctggagttttggagttatcaatcaaacaggggtaattgacaaaatatttaataacctgttaggcacaggcattgaccagtcagaacagaaactagccattatgcaataaaggtgtgcattagctgaagatcagccccgattacaaaca

SEQ ID NO: 336016 - DNA, 268 bp, Homo sapiens
tgagaggagacaatcaaatagggtattcggtgctatgataaaggtgagcacaggttgctgtgacaatagagaacaagggtactcaaattagggtaggctctgttgatggaagtgacacctgagttgagtccctgatatagtttggatatttgtctctgcccaaatctcatgttgaaatgtaatccacaataattggaggtggggcccggtgggaggtatttggatcatggaggcagatccctcatgaatgccttgggccatccacttg

SEQ ID NO: 336017 - DNA, 199 bp, Homo sapiens
ttcacatcacataccagttgaaggcatcacccttctttcttagatgactactgccttctcatatatatgtatttttttttctctttagttccgtgttagtattaatatgtttttctttttctattttttttttagatggagtgtcgctctgtcacccaggttggagtgcagtggcgtgatgttggctcactgcatcctc

SEQ ID NO: 336018 - DNA, 230 bp, Homo sapiens
ccgagattgtaccactgcattccatcctaggtgatagagccagaccttgtctaacaaacaaaatgtggattatggagcgagtataagaaatgtatcatctatttattttccagtgtaaaatcaccttattctacagagaagattccagtatgttgaaccaaagcagagtcagtgatgggtatcaagccctattctattgagagcagagttgagtcaggatggccactggg

SEQ ID NO: 336019 - DNA, 938 bp, Homo sapiens
tcttcattcttatgagctcccagagaatgctttaaagcctattccaaagctgcttctgcttcattctaaccacatacccagcactattttaagcttagggaatttaccaatactgtctagcctctcctaatctacaccgtacactgataagtacaaaacattaggtgaccgtggctgtcctggaaacctgagaagcacattaccccatagcctgatgcctcattcattcagcaggtgtgagtgaggccagttctgttccaagtgttccctggtacactcgcaggggcccaggccacgtgcagaccacagtgagaatgaccccagccagatatttaaaaggaacacaggctactgttagaaggaaagccaatcccaggacagggtcaaagtcctgaaacgttgtatatctgttgacctagaaattattctaagaatttatctaaagaaatgttcatgaaaaaagagcagatttagttacaaggatgttaatagtagctttacttataaaagcaaaatatttgaaacaacccgaatgatgctaaatataccaaggtacagccacatgatgagattcaatgacatcttgaagtgcagtaagggttttgggatggggaaggtttgcttttagaagttatggtaaggaaggccactactttagaaatacaaggggattaaataagcacctttttggtgacaaaaagaaagataccaatccagatatgaagcctctcctcttcaaggcaaagtagctcactgtcctgcctctgtccctttactgtacctcacagaaacgagttataataatgatgatgatggcaatacctgtgccattaccacccagcatttactgagcactgactctgctcctggcaacatttgaagggccttaatcctcagaacaaccccatgaaatagaaagcatcaaccctattttgcag

SEQ ID NO: 336020 - DNA, 158 bp, Homo sapiens
tgaggtgaacgtgattgtgctctgatcattcagaaggcacatgactcttttgtagtgcttcagagccatctttccattatagtactataaaataaatcagactggtttatcttttgagttacttggtgtttgaataacaagattttttttttgaataa

SEQ ID NO: 336021 - DNA, 457 bp, Homo sapiens
ccccactacaaaataaagctaaggagtatctagtgtgtcaaatagagactgtttgatccagtcattaggacttttacagctccttttaaaacaacactgagtcatggtagaaagataacgattcccagtgtctttatgtaagggatatttgaataaaatatgccaatgataactgctattatttaatgataactgtctaaatttgattgtttcaattggaaggttaaatattttctagtgggtattccctgttgcataaaataccacagcaatagcaaatgctcatttgaaatatgcttgttttattagcatgcagttactagttacaaatttttgcttataagaaaagctataaatatacgtgacaataatctgtattttcttagcagatatgtgcaaaagaaatgtaactatgggagagttttgttttcttgcgttttcttgttctgtttttata

SEQ ID NO: 336022 - DNA, 714 bp, Homo sapiens
attttaaatacttctggactcccccgtgaaataagacagcatggggtatgtctcaaaggaagtgatttcctggcggtcatctccaagtccaaagagcagattctgcccaaggaattgacacttcataaagtttactgaaaaatcagcaaatgaaccctgattcctggcaaacctccattaattagcaataagaaatccctctattttccccaccaacagagaggatgagcagtgggattcgtggccagtacttcctgcttctttgctaagatctagatgcactgaggactcaggtccaaagaccttcattccattaggaaaaacagcagctgagttaggcctcccttcccccagcctagggctgtgagtgaacttcccctcctctagctccaccacctgtctctggaccaaatacagatcacagagaggcatttcctgagctctgcaagcttgctgaccccagaggttaatcctacccctctacggccaggccaccagacgagagcctctttcctcccaaccaaaggaaccacagaatcctagaatttcagggcttgaagggacctgagaagcccgcacgttcaaggctctgaaatgtccagggattatcccaaggtcacaaagcagaaatggagaggccaggattcagagctaggtcctctgaccctcaccctaatgctctttactctacccaagacaggacctccttgccat

SEQ ID NO: 336023 - DNA, 189 bp, Homo sapiens
tcaacatcactaatcattatggagatgcaaataaaaatctttatgatgtatcacttcacatctgttggctataataacaaaagataaaaactggttagaatgtaaagaaaagggaatctttgtacatggttagtagttacataaattgatgtagtctcttcagaaaatacaatagtatggagcttcctc

SEQ ID NO: 336024 - DNA, 453 bp, Homo sapiens
tggagtgccactgtggatcatgtcatgccttcatttgcttaattaattaatcaagctaggcaaatatttgtgtgcctattgttagccagggtctgggtgtaaaataatgtccagaacccatctgatctctgatgtcatgaaacatcatttattagagagagataggtaataaacaagtaaacaatgaattaaattgtagttgtaacagggtgatgaaggaaatgtacaaggttatgtggtaaggaaaagcaaaggggtggcgacagaagatgtttctgagtgtgggggttgtgttgtgttgtgagtagagtgagaggtctgggcagaagaaagcactccgggcacatggaccagcatgtgcaaaagccctcaagtgagggcgcagacacctcagggggttctagtaactgtacataggccagcgtgactggaaccagtggggtttggcatttt

SEQ ID NO: 336025 - DNA, 132 bp, Homo sapiens
gaaaaggtacagattttaggggggagaaaacaaagtttcagacatattgagtcaggtactggaaagacatccatgtgttactatgaggagggaactattcctatcctcccctcttacacaccaggaaacctg

SEQ ID NO: 336026 - DNA, 595 bp, Homo sapiens
gactatgcatcttcaagactcagctacacatcatgttgtccaaaaacccttactaatccctgaaagggaatatattataaatctccacttctttaagatcctaggaacaggatgtgtttcctagttcaaaaattttcagattttgaaaaggtaatagcgtgtatttaccaaatactacctagcactatcctaggggtgtctggggcaagatgctataatcaaacacataaacatttctcccacaaaacacaaaaatatgagcacttttaagatgaaattaagactacaaacagttttacagcactgtatgtcagattttgctgccaaatgaattcacattagttcatattttaatgctaaataaactacaaaaaaatcctttgcatatctgaacctgttggatttcagagtggcaattaagagactgtggacttggtcaacttcccttaataaaatgaaatccagaaggtccagggtccatacataaatggagacttccagtgaacaggagcaaccaataacaacctaaacttcctgcactggggtttcattttcctcataggattctcccacttggtaacagacccgaggtggg

SEQ ID NO: 336027 - DNA, 338 bp, Homo sapiens
aatctctggggtttcctgtaatctctgtgacaattgcttctctttagtaagtacaacaaaagctgaacctagaatttcaaggggagagggaaaaatgatttggtttttgaaactgacttggtttttcatttttaaaaaatcaagacactgcaatgccagtttagtttttaattcaaaacttaagagagaaatggtagcactcctcctgtgcatggctgagtcagcacaaactgttgcgcagtatcagacatgtggctccactgcggggaaccccgcatggcctggcatttgctctaagggctgctgggagtcgttgccacagcaaccaatggggtgag

SEQ ID NO: 336028 - DNA, 1123 bp, Homo sapiens
cctgcgggcagctggccgcattctcaggcagacacggagcccccaggggcatctctgttttctctccccaccctgctggctcagcctgagcaggactaggactcacttaaggaatgagggccgcctggcagctccacccggcccagccctgctggagggaatcgtgatgaagaacagggcagctgcactgagggtgatggcgtgctgccctcagaattgcttttctcggctctaattttcctgatgcgagaaaagccagtaaccccggggtacatccaatagtcaggacatggtgctgattggacttgaaaagtccgtccagccagctgtgcttctgattatccctattcttaagtatctgtttgggctggggctgtcactccactgatgcccccccagtttacaaggatggtccttggcctgggtggcagtcagatggtcagatgtgcggctcagctgcaggggccactgaattgtgtcgggtcatggagaggagaggggcacccagcaaaaaccagctgcaggccacggccctccggggcttctcagccctggcagctctgggcacgcttaccactgcatgcgagaccaccttccttggcctggattcctgggggaggtcctcgcacatgaccttgtctggtagctgcagtttgtccctcgttgtgccacactttgcaccaccaccttcaacagctacctattgaggccccatctaggtgctggtgccatcatggttctgtcttgacatctgggacagcaggctttcctggagcctcatgtacctgccttcccacacaagctcagaggagcagtttagcatttctcagtgactcggggtcaccctgggaacagtcatctttgtactttagaaaatggcagctgggcacggtggctcacgcctgtaatcccagcactttgggaggccaaggtaggtggatcacttgaggtcaggagttcgagaccagccaggccaacatggtgaaaccctgtctctactaaaatacaaaaaattagccaggtttggtggtgcacacctgaaatcccagctacttgagaggctgagacaggagaattgctttaacccgggagctggaggttgcagtgagctgagatagtgcca

SEQ ID NO: 336029 - DNA, 190 bp, Homo sapiens
ggatggcatggaaaggaaacagcactaaaaagtattttttatggtatttgaaaaatgcagggagaagactttagagttattttgaaattatgctttggttgttggaaattttttgtaaaccttaatattgctgtaagttggatcacctagattctggctctgatagggttacaaaaatagtgctacaagt

SEQ ID NO: 336030 - DNA, 368 bp, Homo sapiens
acaatctcttccagaatatggaagagggaggcaatacttcccaactcactgtattaccctaacactaaaaccaggccgggtgcagtggctcaccgcctgtaatcccagcattttgggaggccaaggtgggtggatcacttaaggtcaggatgaataaatgcacatgtgagtaaggaatgaagggagcgaaagaactggattagaagctgcttggggcagagatgtgccttacaggcttcatgaagagtgggtgatgaaaaaggtaaatggagcatctaagaggaagctttgatagaagggagaatgcaagagaggttggaaattggaatccattggaattgggagcctggggagatgccaggacaggc

SEQ ID NO: 336031 - DNA, 222 bp, Homo sapiens
ctctaggaactaaccctgtgaatcatagttctgtggatgaaatattttctcgccaactggatttctttgtagacaacacagctaaagtagtgcccatctgctcttaggaaacaattgatccaggctactcaaaaaggactttgcatctctgcatttcagtatttgtggtcaggatttaattaatttggttgatttagaaagcagctctgcactttccttcca

SEQ ID NO: 336032 - DNA, 522 bp, Homo sapiens
ccggcctctgcccctggccatacaccatgtcatagttatcccctccaccacaccagccatgctgagcaactgtgctctatgtgccagtgctcaaggtggttctccagctgctggctcctggtttgcccttttccattgcaattaactaggctctgcccacttctgacttgaaactggccaaaatgcagggaaggaagatacccccaaaacctcagtaaatcttctcaaacatcatcctgttcaacagtcacaaacctggtgtatacatagccaaagtccagtaattctcctaattttgattccatgctggtgttattaaaggccctgaggataaacttactactcaaaagtcaaatccaacagctttgtcatcacaaaaattgaaagaaagaaagccaacaagtatctgtggctctttttttcagggaagtattctgttggcatttaaaaaaatgttcattttgaatggtttcaaatgtcgactcctatctatggctcttttgaaaactacacatggccggg

SEQ ID NO: 336033 - DNA, 434 bp, Homo sapiens
ccggcctctgcccctggccatacaccatgtcatagttatcccctccaccacaccagccatgctgagcaactgtgctctatgtgccagtgctcaaggtggttctccagctgctggctcctggtttgcccttttccattgcaattaactaggctctgcccacttctgacttgaaactggccaaaatgcagggaaggaagatacccccaaaacctcagtaaatcttctcaaacatcatcctgttcaacagtcacaaacctggtgtatacatagccaaagtccagtaattctcctaattttgattccatgctggtgttattaaaggccctgaggataaacttactactcaaaagtcaaatccaacagaatacttccctgaacaaaaagagccacagatacttgttggctttctttctttcaatttttgtgatgacaaa

SEQ ID NO: 336034 - DNA, 197 bp, Homo sapiens
atccaactgggttagtattgaactagcgtttaaaaagggaaaaagaacagtgaattttaaagttggtatgtaacttaaaatgtgaccccaaatcatgatccctgcttgaagaattggtcaaaataaataaaaatggatcacatgctctttaatgtcactgtcttgtctgaaatcaaaccttcaggaatatttatctg

SEQ ID NO: 336035 - DNA, 175 bp, Homo sapiens
gcaggagaatagcttgaacccgggaggcggaggttgcagtgagccgagaccacgaaattccatctcaaaataaataaataaataaatattgaaccattaagcgccttacctagttaaaattaattgcatttaaaaaaagtgtgaaataatgtgtgtttttaaaaaaaaccccatc

SEQ ID NO: 336036 - DNA, 102 bp, Homo sapiens
ggagctccagcggtgaccacatgtataaatgcttggattatatagtgaatcaaggaaggggacaaaaagaaagagtattttaaaaagtattcttaaaactgg

SEQ ID NO: 336037 - DNA, 847 bp, Homo sapiens
cagagtaagaccccatatcaaaaaaaaaaaaaaaatggaaacggcaataagggagccagagtagaagcaagtagactaattaggcagcaacaatcctggcgaaaaatggtggtggctcagaccaaggtggtagcagtagtgatggtaaagagtggtcaaattttaaatattttgaaggtaaagcaagtaagatttcctgacagattgtatgtggagaaagaggactttaggacaatgccaaagcctgagcagctggaagaatgaagttgctttaactgagatggtaggtagaccagctttgggggaaatactaggagtacatttttaatatgttaattggagatgtctgtgatatgtccaggtttgagtagacagttggatacttccctggagatcagggaggaggtttggggaggagagttttcagcatacatctggtatctaaagccaacagacaggatgcgatcaccatagaaagattatagatagagaagctgcccctttgggccctctttaagaagtgaggacccccaactggctgctctgaaaagccatctttgcattgttcctggttcggtgtcctgctcaccacagccacctccgccatgcacttcctctgctgcctcagagtctggcagcttaatcgacatagtccccaaactctcactttcttcttaatcccttgcatcggatcaccgctgtgccccaccatgtcagaggcagttgtggacacaagctccgtgatcaccaccaaggacttcaaggagaagttgtggaggaggcagaaagtggaagagacgcccatgctaacgggaacgctaatgaggaaaatggggagcaggaggct

SEQ ID NO: 336038 - DNA, 252 bp, Homo sapiens
ccctggcaaggggactcacaccctgcaacagcaactctggtccgtgacccccctggagagctatctgtggatcccaagccattcccagaccacatagctggtagctggcacagggggaagcatgccagggtccagtgaccccagacagtcacttaggatgtgatatggtttggctgtgtccccatccaaatctcaacttgaattgtatctcccagaattcccacgtgttgtgggagggacccaggggtgagg

SEQ ID NO: 336039 - DNA, 484 bp, Homo sapiens
cgggggagtgtcgggaccagctaggggagttgtcagaaagttcgtgcgggagtggctgcaggtggcgtcgtgggagtctgtaggagggtgtacgggagttgtgtcgaggggttgctgccacaggtcactgagggtagaactgattgttagtgtgatgacgcctggagttttccctgtcggagagatcgggggtggccgggtcggttggagttcgtgggtgggcgggtacagaagttgggctagttgtgtgggtcacagttgttcgtgctaggcctggggtctgtaagctgtgcgtgtgcgtgctgtatgcgtcggtgaaaaccctagggtttgtaaggcttgagcgatgggtccgggccagttatcctagcgctgttggttaattgcctggcgtgagtgtgtctgggtgcggtgtggggtgcatatgtgggaagcctcccagactacagatggccctgtgtggcggaacaccgaggtggagaag

SEQ ID NO: 336040 - DNA, 202 bp, Homo sapiens
catcctccagacctcagattgatagatcccatggtagcttgcaccatgagcctggaaaagccccagacactcaacaccagcccatggaagccactgcaggagctgtaccctgcatagccacaagggtacagctgtccaaggccttaggagccaactcctgccttcagcgtgccctgagtgtgtgacacaaagtcaaaagaga

SEQ ID NO: 336041 - DNA, 502 bp, Homo sapiens
ctgcagcgggaggccccacttgcttctggaaaccattcaggtacacgggtgtcctcagttgccagcccgatggaccacggaagaacacttcatccctgccactgccgtggtgctgactttttgccatttcttaggaaccttgggatgctgccttcataccatgcctactgggaggaaggcctcgagttctatatcagacccctggggtttagtgcattcttcttgcagaccaggttcagaaggtctcctaatgtcacacactcacaaataacttctcatcaggcgaagtcggcctcatcatgggcagaggggcttgggaggtccaattactgggcaaggagggaaggggattttcaggtattaagaatgcaaagtggccaggcgtggtggctcacaggctaccctcagattcttagagagaagctccccgcccccagacacttggtgggtgatgaactagggtaaccatgccttccattatgggggtccttggaggggccag

SEQ ID NO: 336042 - DNA, 414 bp, Homo sapiens
tgatccccgaggtcaggagatcgagaccatcctgactaacacggtgaagccccgtctctactaaaaatacaaaaaaattagctgggcgtggtggcgggcacctgtagtcccagctactcgggaggctgaggcaggagaatggcgtgaacccgggaggcggagcttgcagggagccgagatcacgccactatactccagcctgggtgacagagcgagactctctcaaaaaaacaaacaaacaaacaaacaaacaaaaacaaacaaaaaacaacaacgtgatccccacccccatttagtgtacattggtttggtagtcttgactgtagggccaaagactgtcctttgaaatgtaggtatgtggggctgggtgcggtggctcatgcctgttatcccagcactttgggaggccgaggc

SEQ ID NO: 336043 - DNA, 433 bp, Homo sapiens
tatttcatttttttactgcaaaaacttagtgaaacttaccaagcttatcccattttgaaataatttttgtaaagtcttttaagtattatcaaattaatatgtaggtattgtaatattatacacagtaatggcctgactctttagtgagggacagacagaattacaggttatgacagcttaaagcaaaccaagcttttcatgttgtgcaggtgacctcttttgctttcatgattgactgaatctactgaagacagaaaccagcttcaattttggtaaccctgtatgtgttactgaactccaaaactcagcttcaccacctgtataataaggctagttattcctacctcattgagttgttgtgattacatgtttaaaacatttggcacaatgcttggtacataataaaaactcaataaattatatgtaaaagtgt

SEQ ID NO: 336044 - DNA, 185 bp, Homo sapiens
tcataatagataaatgtaagtctttttttaagcattcaaacatgtttgaacttaattatattttcttaagcattttgaattatgattgtaagtctaacgtaccattgttaaatatattggattctcttaaatgtttcaaatggcttagtaacagcagaacattataatgattataaaacaacccc

SEQ ID NO: 336045 - DNA, 160 bp, Homo sapiens
cactgattttggccctaagtagggtttttagatattaagaagcatagttttggtgaatggatttaattttctgtcgtttaagttagaaaaacattcgtttgcattaagttaaaaaattttctcttatagtattggatagcaatagcctaaaaatgcatag

SEQ ID NO: 336046 - DNA, 247 bp, Homo sapiens
gtggtggacttttggttgtttccatggagctgctgctgtccagggcatcaccatgattgaagttcttcccgtcttccagtgggctgcagtaggtggcaatctcagcctccagcttgaccttgatgttcagcagggcttcgtactcctgggcctggcgctgtccctctgcccgagtctgtgccagctctgactccaggtgcagcaggatggcattgagctgccccatctgcagggcatagcagacctc

SEQ ID NO: 336047 - DNA, 449 bp, Homo sapiens
aaagtaacagaaggcagtcacacagacactagactaactaaacaagttatgaataaatgagagtcactgaagacctcattaattggatttagctggattttaaggactgaacagaataggaatagtgtgaaaggaaggagaatacaatctaggcaaagagttaataagcaacagccaaagatcagaaataaaccaagtcatgaggggaatttttgtagaaaattcattcttcaatttgtataatgcctaggttttaggaatacaaaaatataaggtaccatagcacgtcttcaacgtgctcacaaagagctggcagcagggactcatgactcccaagactttgaaaggctgaagtgggaggatcgcttgagcctaggaattagaggctacagtgagccatgatcatgccactgtattccagcctgggtgacaaagtgagaccctgtctc

SEQ ID NO: 336048 - DNA, 824 bp, Homo sapiens
agcacgccctctatattctccactgtgcgtcactggtttctaacctcctgacttccctgccagcaaaaagatgaggtgggtgcaaaggaaactggcaacggggattttcctgggggcttcttctaaattactgctgaaaagataggtctggccccaagctacaaccagtggaggctaccatctggacttgatccggagcttaacccactctgtagtccaattctcatcaaaagtctgggctgtagtgaaggtggtctggggagcagcccactgggagccaccagaatctggcagtcactgcaagtccctgagggtcagggaaatctcaggtctagtccctgtatggtcactaactagctatgtgacgtgtgcaagcgataacatcattctgggccccagctgcaccctctgtacaaaggggagaataccccataaggttactatgaggattaaataggaaaatcaaaaaataaaaataaaaaataaaaaaaattaaaaataggaaaatcagtatagtatcaagccctatgtcaagtctgttgagcattgtgtctggcacacagtaagagttacataaatgttagctgcattctcatcaccaccatcacatgtcaggtcctttcatccttgacaagagcaaaacagaaccttaaatttgtgtctcttgcctgtgatcacagagccaaggagtgggtctcaagtcaaggtctcgtggtagctcctaaggaaaggaagcaaatggggtctggtcccttcagtcatatgatttctactctgttggctcacgtaagaatggcaagtcactagttttgaggactgaacct

SEQ ID NO: 336049 - DNA, 413 bp, Homo sapiens
agcacgccctctatattctccactgtgcgtcactggtttctaacctcctgacttccctgccagcaaaaagatgaggtgggtgcaaaggaaactggcaacggggattttcctgggggcttcttctaaattactgctgaaaagataggtctggccccaagctacaaccagtggaggctaccatctggacttgatccggagcttaacccactctgtagtccaattctcatcaaaagtctgggctgtagtgaaggtggtctggggagcagcccactgggagccaccagacaggttcagtcctcaaaactagtgacttgccattcttacgtgagccaacagagtagaatcatatgactgaagggaccagaccccattggcttcctttccttaggagctaccacgagacctgggccgaa

SEQ ID NO: 336050 - DNA, 112 bp, Homo sapiens
ccagttaggaggacatggaatgctttaggcagaggcaccaagggcctcaaatactgcaactgactgctcaggcagctctcagatgacactgggcaatcgagagaaattgacc

SEQ ID NO: 336051 - DNA, 254 bp, Homo sapiens
ctgggaggatacagatgaagaaaagactggaggcactcaacttcaaggaacaaattgcctgagtgtgtctggcccactctaccctcataaggtagtcttcttggctgggcgcggtggctcacgcctgtaatcctagcacttttgaagaccgaggtgggtgggtcacctgaggtcaggagttcaagaccggcctgaccaacatggtgaaaccccatctgtattaaaatataaaaattagctgggcatggtggcag

SEQ ID NO: 336052 - DNA, 638 bp, Homo sapiens
cattttaattgcatctcaattaaacacgataaaaaaatcactcctatttgattttggaaagagagagatagaaactgacagaatgtctgcctaagaatgccttcatgcttctccaatgggagcaactgtacagctatggatttacagaaatatctagtgcctaggtataattgtatcttttcttcccataaaattttaacaatatactcatccagtgcccccttccaattttcagtttccctaattttttttaaaacagcctaacagtccacagtcaaaactgaacctcataaaggcatgtttaagtacatcaaatggtgagacgaaaatataaatttttatataaaccagaatgagtcttaagagggaaattaagatctaactttgctttttctgtcttctgaaaatatacgttgatatcctatagtcctttctaccaaccacatttcccctacctccttcccatagttaattaacacctactaatctctcgtctctcaaattaaattttcttttctcagaaattcttctgagtttctattactccaatccacccccacaactcacacacaattatagtcttgagctgcttaacaacaaggatatggtctgagaaatatgccaataggtgtgttgtt

SEQ ID NO: 336053 - DNA, 431 bp, Homo sapiens
cattttaattgcatctcaattaaacacgataaaaaaatcactcctatttgattttggaaagagagagatagaaactgacagaatgtctgcctaagaatgccttcatgcttctccaatgggagcaactgtacagctatggatttacagaaatatctagtgcctaggtataattgtatcttttcttcccataaaattttaacaatatactcatccagtgcccccttccaattttcagtttccctaattttttttaaaacagcctaacagtccacagtcaaaactgaacctcataaaggcatgtttaagtacatcaaatggtgagacgaaaatataaatttttatataaaccagaatgagtcttaagatattaatatcctatagtcctttctacaattccatatctctcgtctcatcaaataaattttcttttt

SEQ ID NO: 336054 - DNA, 327 bp, Homo sapiens
tggctacagagtccagctcctaagcttcacgtgtgccccatgctcagaaatttacttcttgtatcaagaaggtatagacctccagagcccataggtagccacggctatggactgttggcctctaggttaagaaaccctgaatttgaagcttccagcttcttctactgtctccatcattctgctttgatttcatcacaatctacattaatcacagcaaggatagttctagaaacttcattcaccacatagacctttcctgtctttgctcttagcccatctgtcctagttagttcaggctgctgtaacaaaataacataaactggtggc

SEQ ID NO: 336055 - DNA, 537 bp, Homo sapiens
gggactgcagggagaaagatcttataatgcctgcccagggctttaggctgtgtcagctttctgcatctcttctccagctggagctggcagggtcgaataaatcactgcagagtagttatgagcccagctcaccagggacttctttgaggcacacctgtgacgtcatcctgttatcactgtctgttccacataacctcttttcacctctcccctgagagagggtgatgcccagaactcatgtcagggcaatgagcagaggaaaatgtttcgtaagtattatttttcagatgcctgctagggatacagttgtaggccattgacacattcttcaatattcctcattggaagagaaaacctgtgtttgcaaacatggcctgaataccccttgtggataaaacttctttttaaacttggaaagaaagtcttgaaactcctaagtggtctctttttgtaccccttacctctctcgttccttcccaaacatgcacacacagacacattacatacagagtctgctgtgttcaaaatccttcactg

SEQ ID NO: 336056 - DNA, 2152 bp, Homo sapiens
tccctaaaaacagttgttttttttctgaagtgaaatacaggtggagactaacacatcccctctgcttgtcataagctcattatctggacctcaggtccttttgagagagcccaccaaggccttgggctctgagcccaggtgaccagcagacatctcaggtgtgtcagggcctgagagcactggacatggacatggtggaaggactgtccagccagtgtcctggaaatatttgaacacagtggggagacctagcagggttttcccttgaagtagttgactgaaaatctgcattccttttggacacaggtggaagataatgaagtaaaattgtctgagaaaacccagcaagcagtgaggggggatgagtctttcctgggcacttatctaacaggaggagaaggagcatatctttattccagcaatctacagtcctggcctgaggaagggaatgttcatttcttctctagtggccttctgttttctcactgtcgtcatggaagtatcatcatttccaaggatcacatgaattccatttccttctatgatggggattccaccagtactgttgctgctcttctcatagacttcaaaagctcattgcttcctcacctcccagttcatttccatggatcaagcaattttctgatgattgcccttttccccaaatcgaagatataccaagcattttactcagaggtcttctccctctggaaacagcaggataactcagggatctctttaaaagtgatccaggaagatggattatctgtggaacaaaagagattgtaagtggctgcttcagtatttgtgcttgcttccctaggctttgtgggtgtgctctctctgcaggatgcctcgcattatgtaacacaggggtcttggcttctgaaagggtcaacacagacatttcaatgctgccaacttgcaggtagccggtgcccttgggggaatagaaggcaagagagggccatgtgcagtgcctcacacttgtaatcccaacactttgggaggctgaggcaggaggatgaattgagcacaagaattagagactagcctgcctgggcaacatagtgagaccccgtccctacaaaaaataaaaaattagctgggtatggtggcacatgcctgtagtctcagctagtcaggaggccggggtggaagggttacttgagcccaggaattcaaggttgcagtgagccgtgaccatgccattgcacttcagcctgagtgatgaaacaagaccctttctcaaaaaaaaaaacgaaaaatgtccccactgccaggagccagtgtggctgtgaggggccacgtctcacagccctgacccgggccaagcatggtgttgggcgccgggcccgtctcacctgtcttggggggcgcccagtgtcttactctgtcaccccgggtagagtgcagtggtgcggtcctggctcactgcagccttgacctcctaggctcaggttatcctcccgcttagcaggtgggactacagaggttgcagaacttgaagctaatttaccttgtacatgtaaagtgcattttcctgatccaaacaagcttcactgttctcagctaacagtaactccagatgagggttactaccagggtggaaaatttcagcttgaaaccgaagttcccgatgtgtacaacatggtgcctcccaaagtgaaatgcctgaccaagatctggcaccccaacatcacagagacaggggaaatatgtctgagtttactgagagaacattcaattgacggcactggctgggctcccatgagaacattaaaggatgtcgtttggggattaaactctttgtttactgatttttgaattttgatgatccactgaatattgaagctgcagaacatcatttgcaggacaaggaggacttccagaataaagtggacaactacatcacgcgttatgccagataataaaaggggacggttgcaggcccatggactgtgttacagtttgtctctaatgtgaaacagcaggaggtagccccacctcccatcctcacgctccctctcagtcccctggattgccccagtcctgtgaccatgttgccctgaagaagaccatcttcgtgactgctcattgtagatggggaattcaacataaatacagcaagaaaatgtgtttgggcttcttt

SEQ ID NO: 336057 - DNA, 1476 bp, Homo sapiens
ccatgtatgcacatgagctcgaattcccgggctcgggtgatcctcctgcctcggcctcccaaagtgctggaattaaggtattagccaccacacccagcctcttgtttatttagatctgctattgactctttttttgttcaaatttaacctcggttttttccggatcctttctcatcctgcctttcagggagcccttgcccacttcttgggtctccagtcactcctagccctcatctccttagcatgtaacactttttcccattctcatctgtgtgaccttcgtgcaacactgctgtactgttttttttgtctgttttgttttgtttttgagacagggtcttgctctgttgcccaggctggagtgcagtagtgcaatcctaggtcactgcccaccccagcctcccaagtaactgggactacaggaacacaccatcacacccagctaatttttttgttgtactgttggctgtgccctcctcccttggcctctgaggcctctgctgagagccccccacttctaccaagggggtttctttgcttttcctcaaccacctcttccataacagctattccagcaaccaccagggactatgtggatgtctcacgctcagggtcttagagactttcaaatgccacaagtgcagagtcaaactcttcctcttctcccacctataaaccttttttttctcttgtgtttcccttctgggataatagtgtccacctgatcacccagatcagccaagccagaaacttattttgttcctctctgtctctctctcttactccatcctttcttttcctttttaaaaaacaaaacaaaatgggatctccctctgtcacccaggctggagtacagtggcgcaatctcagctcactgcagccttgaattcctgggctcaagtgctcctcctgcctcagcctcctgagtagctgggaccacaagcatgagccactgtgcccacctactccatcctttctaagctgccaccagtcacatcagttctgtctcttgcattttctcatgaatctatcccaaccatctgcattgtcacagtcttagcatagctgtatcctttcaaggcaggctctcagggactaatgtgtattctccttacagactctgagaggaccatggaggtctgctacaacacactggccaactccttgagcatcatgccagttttggaaggacccacaccaccaccagactccggctgctccctgaaggaagacagcatcaaggactggctgcggcagtcagctaagcagaagcctcagaggaaagccctgaagaccagggggatgctgacgcaacaggagatcaggagcatccacgtgagtgccttgccctggcttctcccctcggtggcccagggctgtcctcggcttgcctagctctgtattttggattctctgagtgaggagctgtttgtaggacatgctggaggtcttgcttctcccaggccacagagggaa

SEQ ID NO: 336058 - DNA, 741 bp, Homo sapiens
tgggattacaggcatgagccactgtgcctagtcagcataaagcaatttgagggaatatacggaaacataaggatactttccttatagcccaagggtgtctctgatcagggagcaatttcagggaagcctgggtgatcctaaagtcacctcccagttcaaagatgtatttaggataactccagttttccctagaaactcttcagtactcttttgccatgttcctttaggcagtatttgtggtctcattcttatggacttctctgaaagttttgggctggtaactgatctaactggtttctcattcaatgcaggcttgtatggccgtctatgacattcctgacttactgggaggcaatggttgtttaggatctgtggttttctctgaatcatttttgacttctcagatcttagttaaagaaaagggtaagtatatgtgatctttagaaagcaaaccttaagcctttttttttttttttggcaaaataaactataaactaaggcaaaaggccaacaataaactggtaaaaatattagaactgatgatcacagcactgcactccagcctcagtgacacagtgagaccccgtctcaaaaaaaaaaaaaaagagaaacattaaagatgaacaaagggtgtataacctaatttatgaagaactcttccaaaattaataagaaaagataagctacccaatagtaaaatgagcaaaaaaaatgaacaggcacttcacagacgtggaaaac

SEQ ID NO: 336059 - DNA, 209 bp, Homo sapiens
gctggtagggaattaactggcatgtgtgtggtgttcctgcagatggcactgttaccacagaaaccagctccgtagtcctgactgctgctgtacccagattctgctcctggctggttagtgtcattcatcaggtggaagtggacctacgtgtggagaaatcagggtgaacacttgaggaagagcctctttgttgggcccctggtgggatg

SEQ ID NO: 336060 - DNA, 5768 bp, Homo sapiens
tgggattacaggcatgagccactgtgcctagtcagcataaagcaatttgagggaatatacggaaacataaggatactttccttatagcccaagggtgtctctgatcagggagcaatttcagggaagcctgggtgatcctaaagtcacctcccagttcaaagatgtatttaggataactccagttttccctagaaactcttcagtactcttttgccatgttcctttaggcagtatttgtggtctcattcttatggacttctctgaaagttttgggctggtaactgatctaactggtttctcattcaatgcaggcttgtatggccgtctatgacattcctgacttactgggaggcaatggttgtttaggatctgtggttttctctgaatcatttttgacttctcagatcttagttaaagaaaaggatggcactgttaccacagaaaccagctccgtagtcctgactgctgctgtacccagattctgctcctggctggtggaagataatgaagtaaaattgtctgagaaaacccagcaagcagtgaggggggatgagtctttcctgggcacttatctaacaggaggagaaggagcatatctttattccagcaatctacagtcctggcctgaggaagggaatgttcatttcttctctagtggccttctgttttctcactgtcgtcatggaagtatcatcatttccaaggatcacatgaattccatttccttctatgatggggattccaccagtactgttgctgctcttctcatagacttcaaaagctcattgcttcctcacctcccagttcatttccatggatcaagcaattttctgatgattgcccttttccccaaatcgaagatataccaagcattttactcagaggtcttctccctctggaaacagcaggataactcagggatctctttaaaagtgatccaggaagatggattatctgtggaacaaaagagattgcactccagtgcacagaagctcttcagtgccctgagccagcctgctggggagaaacggagttccctaaagttactctcagccaaactcccagagctggactggtttctccagcatttcgccatcagcagcattagccaggagcctgtgatgcggacccatcttcctgtgctgctgcagcaagctgaaatcaacactactcacagaatagaaagtgacaaggtaattatcagcattgtaaccggcctcccaggctgtcacgctagcgagctctgtgcttttctggtcactctgcataaggaatgtggcagatggatggtgtatcgccaaatcatggacagctctgaatgttttcatgctgcacacttccagagatacctttccagtgccctagaggcccagcagaaccgctctgcgcgccagtcagcctacatccgcaagaagaccagactgctggtggtgttacaaggctacacagatgttattgatgttgtccaggccctgcagacccacccagactcaaatgtcaaggcctccttcaccattggtgccatcacagcatgtgtggagcccatgagctgctacatggagcacagatttctctttcctaaatgtcttgaccagtgttcacaaggcctggtgagtaacgtggtattcaccagtcacaccacggagcagcggcaccctctccttgttcagctgcagagcctcatcagggctgccaatcctgctgcagccttcattcttgcagaaaatgggattgtcaccaggaatgaagacattgagctgattctctcagaaaacagtttttcaagtcctgagatgctacgatctcgatatttaatgtatcctggctggtatgaaggtaaattgaatgctggatcagtctatcccctaatggttcagatctgcgtatggtttggccgtcccttggagaagactcgctttgtggccaaatgtaaagcaattcagtcctccatcaagccaagtcccttctccggaaacatctaccacatcctgggcaaagtgaagttttcagactctgagaggaccatggaggtctgctacaacacactggccaactccttgagcatcatgccagttttggaaggacccacaccaccaccagactccaaaagcgtatctcaagacagcagcgggcagcaggagtgctaccttgtgttcatcggctgctccctgaaggaagacagcatcaaggactggctgcggcagtcagctaagcagaagcctcagaggaaagccctgaagaccagggggatgctgacgcaacaggagatcaggagcatccacgtaaaacgccacttggaacccctacctgcaggctacttttataatggcacccaatttgttaacttctttggtgacaaaactgattttcacccactcatggaccagttcatgaatgactacgtggaagaagccaaccgggaaattgagaagtataaccaggagctggaacagcaggagtatcatgacctctttgagctgaagccctagaggaaggctgggcccgtacgtcctgcagaatgtccaccttggagatggacgaacgggtgtcttaacctcagctctgctggaggcctctcccttaaggggctgtctttgttctccttggcctgtgtgggctggcttgagtgcatgttgtctttattccctgtatagcgctgaagagcatcacctgcaccattgattttgggggtcgggggaatactcaaggatgagcagatggggcctgcccgtctacgtgtgcaactggcagtccaggagctctgggtttctgataacaggatctcctttgggctcttgaggttggggagaagcattaggattacacagaggagctactgggacttagaaggaaccctggctgcctgaactgtggccgtgtctgggaggcgaggccacgacaggcctcaagcctcagatgctgctccacgagagccatcttccccagtggagtgcctgcctcccctgctaggcccgtttccctgaaggagctggccgtactggccgtgggcccagtcctgggaggagcagcacagccttgcccaggcccagtccacagagccagcagcttgggttgagatgaatgatgtgttcacaaatgaggggatttcccttctggactaaactgaaggagaggcttgttgctttccagaggtgtgtggctcttaagttgacatcagcttttccccttgtgggtggttctttagctctcctgtcacaccattcgggtgtcctaatgtagggacaagagcaagcctgctgctcaggccccctggcgaggcttcacctcactgtggaagggggcgtcctgcagctggttagtcttaggcctggtggctgatcacttgtggggtcagtctccagcacccagcgctcccacaagccttgccaaggaaggcctgcttttcagccacaaacttcaggaaactcatccccccgctccccaaagtgttgttgctggccctgggcttgtgtggctcctgaggattgggaatttcaaataattgcaatacctgagttagaattccttctaatggcatcgttttaagctggaccataaagcagaggggaattacaagtgtgtcccatgcctgaccttcataattggtgtgggggacaggggagtcacagccactgatatttaggtgatgtctcttaggacttcagtgcctcagctgcctgaactgtaaatgttttctgaatttcacatatttttttttgcatgccttaggaagaagcacataggtaaaaccagcagtttccagtaatatagggggtttttgagcaaggcccctggagcagcggagagacaagatggagcacatgtagtctgtgtgcctggtcacacagaggcctgcatgcaagtagcaaagcagctctcaagggcttgtcagtaaaatatattagaaaaaaaaaaaaaacaatttgaagccaaatgaacaaaactccagataccattgataagaaattttggcatcaagaagggcttctgaaaagacccacgtgctccagtcccagctccaaaagccactgatgacaagggccccactgtggaacctaagtctgggagccccctgacttctggctggccagaggctgcggtccgtcaagggcttgcctcgcttcagaatcagtaacatagatcttaagtgcaattgattaataagcagtgagttactgtagcttcctttagctctaccgaactctttttaaaaactcaaacttgagcagccttagaaaaggggttggggggtgggaaccacaggccatttctctaagtgggctgctgtgaagttttaaatgaaagctctagctttaggagcttgagccatttcctgactgcactggcctggcagtctggctgctgcacaagagtttttaaagaggggtcggagcccgcccgtgagagcgggtcttctcaccatgtggggctgtactacgtggtggtcttggtttctcttcacagaaatgctctctcaccaacttgccccactgtcccaactcctctcctcttagagaaaaaactgtgattacctcaacttgaatatgaaactgtgattgaaaaaagtcaaaacgtgaagaagcatcaaagccaaaaaggcaaaactggctgaggcctctgttgatgctcctcagcctactcgggaacgtgaaggggcagctggcgaaagggcattcctggggccacttgctctgccccactgataaggcacacccgcggtgcactgtgagctctttgaggactgaggccaggggatgcctcctggaacctgccaggcctctctgttctgtgaaggtcagtatccacttgattcctccaggcggcgctccaggtgggaggagcagggtcttctgctgtttccaaaggaatggccatgacactgcttttgaccttagaagtggatccagggacccagcaaagagcgggggtgggttcccagggacaggcagtcctcccggggcttacatgctttttgctaactttcctattagcagcttcagtttatatcacccagagtgcgtgggataatgttgaagtcgctgaagttacgggttattttatgtttttacatgggatttttctgtttttgattggaagaaggagacagaaattggaggaaatgggattattatcctagggaagggccgttggcaaggagttgagccggcccctctgagccctgggggctatctgacctgaagcctggacactgggcccttcaggtcgcaagaaaaagttccctcctaaattctattaggattttggagaatttttgcacagtaagaagctctgggttgctccttgggcttctcaaaagggaaaagttcaattcaaagattgtaaactacgaagtattccagccgtgttgctgatctagttggatagttgtacctcaaaaaagtaggtgagaactggcttcctcattgtcccaggatgtcaaatactaatgacataagagctcacttacgtgccaaaattcacttttatactagtttttcagtgctttaatatttgtaacttaaattttaaaactcgtatttacaaacactactgtaacttcagtgaaactgaattgtgcgattgaagctttttgcttatcatagtatttattacactacttaattcagtaaatatataaaagtagccttcaatttatttttatattattttacatgtttttacctgcagttgtgtatgtgaatttaccttggtaatcgagatgtcatgctaaggaccaataaactatcactgaacaaaaaaaaaaacca

SEQ ID NO: 336061 - DNA, 4875 bp, Homo sapiens
ccatgtatgcacatgagctcgaattcccgggctcgggtgatcctcctgcctcggcctcccaaagtgctggaattaaggtattagccaccacacccagcctcttgtttatttagatctgctattgactctttttttgttcaaatttaacctcggttttttccggatcctttctcatcctgcctttcagggagcccttgcccacttcttgggtctccagtcactcctagccctcatctccttagcatgtaacactttttcccattctcatctgtgtgaccttcgtgcaacactgctgtactgttttttttgtctgttttgttttgtttttgagacagggtcttgctctgttgcccaggctggagtgcagtagtgcaatcctaggtcactgcccaccccagcctcccaagtaactgggactacaggaacacaccatcacacccagctaatttttttgttgtactgttggctgtgccctcctcccttggcctctgaggcctctgctgagagccccccacttctaccaagggggtttctttgcttttcctcaaccacctcttccataacagctattccagcaaccaccagggactatgtggatgtctcacgctcagggtcttagagactttcaaatgccacaagtgcagagtcaaactcttcctcttctcccacctataaaccttttttttctcttgtgtttcccttctgggataatagtgtccacctgatcacccagatcagccaagccagaaacttattttgttcctctctgtctctctctcttactccatcctttcttttcctttttaaaaaacaaaacaaaatgggatctccctctgtcacccaggctggagtacagtggcgcaatctcagctcactgcagccttgaattcctgggctcaagtgctcctcctgcctcagcctcctgagtagctgggaccacaagcatgagccactgtgcccacctactccatcctttctaagctgccaccagtcacatcagttctgtctcttgcattttctcatgaatctatcccaaccatctgcattgtcacagtcttagcatagctgtatcctttcaaggcaggctctcagggactaatgtgtattctccttacagactctgagaggaccatggaggtctgctacaacacactggccaactccttgagcatcatgccagttttggaaggacccacaccaccaccagactccaaaagcgtatctcaagacagcagcgggcagcaggagtgctaccttgtgttcatcggctgctccctgaaggaagacagcatcaaggactggctgcggcagtcagctaagcagaagcctcagaggaaagccctgaagaccagggggatgctgacgcaacaggagatcaggagcatccacgtaaaacgccacttggaacccctacctgcaggctacttttataatggcacccaatttgttaacttctttggtgacaaaactgattttcacccactcatggaccagttcatgaatgactacgtggaagaagccaaccgggaaattgagaagtataaccaggagctggaacagcaggagtatcatgacctctttgagctgaagccctagaggaaggctgggcccgtacgtcctgcagaatgtccaccttggagatggacgaacgggtgtcttaacctcagctctgctggaggcctctcccttaaggggctgtctttgttctccttggcctgtgtgggctggcttgagtgcatgttgtctttattccctgtatagcgctgaagagcatcacctgcaccattgattttgggggtcgggggaatactcaaggatgagcagatggggcctgcccgtctacgtgtgcaactggcagtccaggagctctgggtttctgataacaggatctcctttgggctcttgaggttggggagaagcattaggattacacagaggagctactgggacttagaaggaaccctggctgcctgaactgtggccgtgtctgggaggcgaggccacgacaggcctcaagcctcagatgctgctccacgagagccatcttccccagtggagtgcctgcctcccctgctaggcccgtttccctgaaggagctggccgtactggccgtgggcccagtcctgggaggagcagcacagccttgcccaggcccagtccacagagccagcagcttgggttgagatgaatgatgtgttcacaaatgaggggatttcccttctggactaaactgaaggagaggcttgttgctttccagaggtgtgtggctcttaagttgacatcagcttttccccttgtgggtggttctttagctctcctgtcacaccattcgggtgtcctaatgtagggacaagagcaagcctgctgctcaggccccctggcgaggcttcacctcactgtggaagggggcgtcctgcagctggttagtcttaggcctggtggctgatcacttgtggggtcagtctccagcacccagcgctcccacaagccttgccaaggaaggcctgcttttcagccacaaacttcaggaaactcatccccccgctccccaaagtgttgttgctggccctgggcttgtgtggctcctgaggattgggaatttcaaataattgcaatacctgagttagaattccttctaatggcatcgttttaagctggaccataaagcagaggggaattacaagtgtgtcccatgcctgaccttcataattggtgtgggggacaggggagtcacagccactgatatttaggtgatgtctcttaggacttcagtgcctcagctgcctgaactgtaaatgttttctgaatttcacatatttttttttgcatgccttaggaagaagcacataggtaaaaccagcagtttccagtaatatagggggtttttgagcaaggcccctggagcagcggagagacaagatggagcacatgtagtctgtgtgcctggtcacacagaggcctgcatgcaagtagcaaagcagctctcaagggcttgtcagtaaaatatattagaaaaaaaaaaaaaacaatttgaagccaaatgaacaaaactccagataccattgataagaaattttggcatcaagaagggcttctgaaaagacccacgtgctccagtcccagctccaaaagccactgatgacaagggccccactgtggaacctaagtctgggagccccctgacttctggctggccagaggctgcggtccgtcaagggcttgcctcgcttcagaatcagtaacatagatcttaagtgcaattgattaataagcagtgagttactgtagcttcctttagctctaccgaactctttttaaaaactcaaacttgagcagccttagaaaaggggttggggggtgggaaccacaggccatttctctaagtgggctgctgtgaagttttaaatgaaagctctagctttaggagcttgagccatttcctgactgcactggcctggcagtctggctgctgcacaagagtttttaaagaggggtcggagcccgcccgtgagagcgggtcttctcaccatgtggggctgtactacgtggtggtcttggtttctcttcacagaaatgctctctcaccaacttgccccactgtcccaactcctctcctcttagagaaaaaactgtgattacctcaacttgaatatgaaactgtgattgaaaaaagtcaaaacgtgaagaagcatcaaagccaaaaaggcaaaactggctgaggcctctgttgatgctcctcagcctactcgggaacgtgaaggggcagctggcgaaagggcattcctggggccacttgctctgccccactgataaggcacacccgcggtgcactgtgagctctttgaggactgaggccaggggatgcctcctggaacctgccaggcctctctgttctgtgaaggtcagtatccacttgattcctccaggcggcgctccaggtgggaggagcagggtcttctgctgtttccaaaggaatggccatgacactgcttttgaccttagaagtggatccagggacccagcaaagagcgggggtgggttcccagggacaggcagtcctcccggggcttacatgctttttgctaactttcctattagcagcttcagtttatatcacccagagtgcgtgggataatgttgaagtcgctgaagttacgggttattttatgtttttacatgggatttttctgtttttgattggaagaaggagacagaaattggaggaaatgggattattatcctagggaagggccgttggcaaggagttgagccggcccctctgagccctgggggctatctgacctgaagcctggacactgggcccttcaggtcgcaagaaaaagttccctcctaaattctattaggattttggagaatttttgcacagtaagaagctctgggttgctccttgggcttctcaaaagggaaaagttcaattcaaagattgtaaactacgaagtattccagccgtgttgctgatctagttggatagttgtacctcaaaaaagtaggtgagaactggcttcctcattgtcccaggatgtcaaatactaatgacataagagctcacttacgtgccaaaattcacttttatactagtttttcagtgctttaatatttgtaacttaaattttaaaactcgtatttacaaacactactgtaacttcagtgaaactgaattgtgcgattgaagctttttgcttatcatagtatttattacactacttaattcagtaaatatataaaagtagccttcaatttatttttatattattttacatgtttttacctgcagttgtgtatgtgaatttaccttggtaatcgagatgtcatgctaaggaccaataaactatcactgaacaaaaaaaaaaacca

SEQ ID NO: 336062 - DNA, 3133 bp, Homo sapiens
ttcagaggatccccagacgatctttgaggcatcacctgcaccattgattttgggggtcgggggaatactcaaggatgagcagatggggcctgcccgtctacgtgtgcaactggcagtccaggagctctgggtttctgataacaggatctcctttgggctcttgaggttggggagaagcattaggattacacagaggagctactgggacttagaaggaaccctggctgcctgaactgtggccgtgtctgggaggcgaggccacgacaggcctcaagcctcagatgctgctccacgagagccatcttccccagtggagtgcctgcctcccctgctaggcccgtttccctgaaggagctggccgtactggccgtgggcccagtcctgggaggagcagcacagccttgcccaggcccagtccacagagccagcagcttgggttgagatgaatgatgtgttcacaaatgaggggatttcccttctggactaaactgaaggagaggcttgttgctttccagaggtgtgtggctcttaagttgacatcagcttttccccttgtgggtggttctttagctctcctgtcacaccattcgggtgtcctaatgtagggacaagagcaagcctgctgctcaggccccctggcgaggcttcacctcactgtggaagggggcgtcctgcagctggttagtcttaggcctggtggctgatcacttgtggggtcagtctccagcacccagcgctcccacaagccttgccaaggaaggcctgcttttcagccacaaacttcaggaaactcatccccccgctccccaaagtgttgttgctggccctgggcttgtgtggctcctgaggattgggaatttcaaataattgcaatacctgagttagaattccttctaatggcatcgttttaagctggaccataaagcagaggggaattacaagtgtgtcccatgcctgaccttcataattggtgtgggggacaggggagtcacagccactgatatttaggtgatgtctcttaggacttcagtgcctcagctgcctgaactgtaaatgttttctgaatttcacatatttttttttgcatgccttaggaagaagcacataggtaaaaccagcagtttccagtaatatagggggtttttgagcaaggcccctggagcagcggagagacaagatggagcacatgtagtctgtgtgcctggtcacacagaggcctgcatgcaagtagcaaagcagctctcaagggcttgtcagtaaaatatattagaaaaaaaaaaaaaacaatttgaagccaaatgaacaaaactccagataccattgataagaaattttggcatcaagaagggcttctgaaaagacccacgtgctccagtcccagctccaaaagccactgatgacaagggccccactgtggaacctaagtctgggagccccctgacttctggctggccagaggctgcggtccgtcaagggcttgcctcgcttcagaatcagtaacatagatcttaagtgcaattgattaataagcagtgagttactgtagcttcctttagctctaccgaactctttttaaaaactcaaacttgagcagccttagaaaaggggttggggggtgggaaccacaggccatttctctaagtgggctgctgtgaagttttaaatgaaagctctagctttaggagcttgagccatttcctgactgcactggcctggcagtctggctgctgcacaagagtttttaaagaggggtcggagcccgcccgtgagagcgggtcttctcaccatgtggggctgtactacgtggtggtcttggtttctcttcacagaaatgctctctcaccaacttgccccactgtcccaactcctctcctcttagagaaaaaactgtgattacctcaacttgaatatgaaactgtgattgaaaaaagtcaaaacgtgaagaagcatcaaagccaaaaaggcaaaactggctgaggcctctgttgatgctcctcagcctactcgggaacgtgaaggggcagctggcgaaagggcattcctggggccacttgctctgccccactgataaggcacacccgcggtgcactgtgagctctttgaggactgaggccaggggatgcctcctggaacctgccaggcctctctgttctgtgaaggtcagtatccacttgattcctccaggcggcgctccaggtgggaggagcagggtcttctgctgtttccaaaggaatggccatgacactgcttttgaccttagaagtggatccagggacccagcaaagagcgggggtgggttcccagggacaggcagtcctcccggggcttacatgctttttgctaactttcctattagcagcttcagtttatatcacccagagtgcgtgggataatgttgaagtcgctgaagttacgggttattttatgtttttacatgggatttttctgtttttgattggaagaaggagacagaaattggaggaaatgggattattatcctagggaagggccgttggcaaggagttgagccggcccctctgagccctgggggctatctgacctgaagcctggacactgggcccttcaggtcgcaagaaaaagttccctcctaaattctattaggattttggagaatttttgcacagtaagaagctctgggttgctccttgggcttctcaaaagggaaaagttcaattcaaagattgtaaactacgaagtattccagccgtgttgctgatctagttggatagttgtacctcaaaaaagtaggtgagaactggcttcctcattgtcccaggatgtcaaatactaatgacataagagctcacttacgtgccaaaattcacttttatactagtttttcagtgctttaatatttgtaacttaaattttaaaactcgtatttacaaacactactgtaacttcagtgaaactgaattgtgcgattgaagctttttgcttatcatagtatttattacactacttaattcagtaaatatataaaagtagccttcaatttatttttatattattttacatgtttttacctgcagttgtgtatgtgaatttaccttggtaatcgagatgtcatgctaaggaccaataaactatcactgaacaaaaaaaaaaacca

SEQ ID NO: 336063 - DNA, 3298 bp, Homo sapiens
ccagccttcctctagggcttcagctcaaagaggtcatgatactcctgctgttccagcttggagatggacgaacgggtgtcttaacctcagctctgctggaggcctctcccttaaggggctgtctttgttctccttggcctgtgtgggctggcttgagtgcatgttgtctttattccctgtatagcgctgaagagcatcacctgcaccattgattttgggggtcgggggaatactcaaggatgagcagatggggcctgcccgtctacgtgtgcaactggcagtccaggagctctgggtttctgataacaggatctcctttgggctcttgaggttggggagaagcattaggattacacagaggagctactgggacttagaaggaaccctggctgcctgaactgtggccgtgtctgggaggcgaggccacgacaggcctcaagcctcagatgctgctccacgagagccatcttccccagtggagtgcctgcctcccctgctaggcccgtttccctgaaggagctggccgtactggccgtgggcccagtcctgggaggagcagcacagccttgcccaggcccagtccacagagccagcagcttgggttgagatgaatgatgtgttcacaaatgaggggatttcccttctggactaaactgaaggagaggcttgttgctttccagaggtgtgtggctcttaagttgacatcagcttttccccttgtgggtggttctttagctctcctgtcacaccattcgggtgtcctaatgtagggacaagagcaagcctgctgctcaggccccctggcgaggcttcacctcactgtggaagggggcgtcctgcagctggttagtcttaggcctggtggctgatcacttgtggggtcagtctccagcacccagcgctcccacaagccttgccaaggaaggcctgcttttcagccacaaacttcaggaaactcatccccccgctccccaaagtgttgttgctggccctgggcttgtgtggctcctgaggattgggaatttcaaataattgcaatacctgagttagaattccttctaatggcatcgttttaagctggaccataaagcagaggggaattacaagtgtgtcccatgcctgaccttcataattggtgtgggggacaggggagtcacagccactgatatttaggtgatgtctcttaggacttcagtgcctcagctgcctgaactgtaaatgttttctgaatttcacatatttttttttgcatgccttaggaagaagcacataggtaaaaccagcagtttccagtaatatagggggtttttgagcaaggcccctggagcagcggagagacaagatggagcacatgtagtctgtgtgcctggtcacacagaggcctgcatgcaagtagcaaagcagctctcaagggcttgtcagtaaaatatattagaaaaaaaaaaaaaacaatttgaagccaaatgaacaaaactccagataccattgataagaaattttggcatcaagaagggcttctgaaaagacccacgtgctccagtcccagctccaaaagccactgatgacaagggccccactgtggaacctaagtctgggagccccctgacttctggctggccagaggctgcggtccgtcaagggcttgcctcgcttcagaatcagtaacatagatcttaagtgcaattgattaataagcagtgagttactgtagcttcctttagctctaccgaactctttttaaaaactcaaacttgagcagccttagaaaaggggttggggggtgggaaccacaggccatttctctaagtgggctgctgtgaagttttaaatgaaagctctagctttaggagcttgagccatttcctgactgcactggcctggcagtctggctgctgcacaagagtttttaaagaggggtcggagcccgcccgtgagagcgggtcttctcaccatgtggggctgtactacgtggtggtcttggtttctcttcacagaaatgctctctcaccaacttgccccactgtcccaactcctctcctcttagagaaaaaactgtgattacctcaacttgaatatgaaactgtgattgaaaaaagtcaaaacgtgaagaagcatcaaagccaaaaaggcaaaactggctgaggcctctgttgatgctcctcagcctactcgggaacgtgaaggggcagctggcgaaagggcattcctggggccacttgctctgccccactgataaggcacacccgcggtgcactgtgagctctttgaggactgaggccaggggatgcctcctggaacctgccaggcctctctgttctgtgaaggtcagtatccacttgattcctccaggcggcgctccaggtgggaggagcagggtcttctgctgtttccaaaggaatggccatgacactgcttttgaccttagaagtggatccagggacccagcaaagagcgggggtgggttcccagggacaggcagtcctcccggggcttacatgctttttgctaactttcctattagcagcttcagtttatatcacccagagtgcgtgggataatgttgaagtcgctgaagttacgggttattttatgtttttacatgggatttttctgtttttgattggaagaaggagacagaaattggaggaaatgggattattatcctagggaagggccgttggcaaggagttgagccggcccctctgagccctgggggctatctgacctgaagcctggacactgggcccttcaggtcgcaagaaaaagttccctcctaaattctattaggattttggagaatttttgcacagtaagaagctctgggttgctccttgggcttctcaaaagggaaaagttcaattcaaagattgtaaactacgaagtattccagccgtgttgctgatctagttggatagttgtacctcaaaaaagtaggtgagaactggcttcctcattgtcccaggatgtcaaatactaatgacataagagctcacttacgtgccaaaattcacttttatactagtttttcagtgctttaatatttgtaacttaaattttaaaactcgtatttacaaacactactgtaacttcagtgaaactgaattgtgcgattgaagctttttgcttatcatagtatttattacactacttaattcagtaaatatataaaagtagccttcaatttatttttatattattttacatgtttttacctgcagttgtgtatgtgaatttaccttggtaatcgagatgtcatgctaaggaccaataaactatcactgaacaaaaaaaaaaacca

SEQ ID NO: 336064 - DNA, 4436 bp, Homo sapiens
attttataataccggagttttgctctatcactgtatcatggacagcaagcttatggaacttattcctcaaaaagtgggacatgctgaaaatacaaacctagcttgagtttagttatgtccctaaatgttaactgatccctgtgggtcagtagggagacagctggcatccgtttccaaccagccaaggatattcggtcgactgtactgactgaccactttgctcaggccgcaagtgtccctcagaaaagcctgaggacttattaaggtcatggaaggttgccttggccaggaactcttttctaatcacatgtttttgacttccctctctagccctaaccggcagccatttgttctctttggtaatcactccacacgagaaaacctgaatgctggcaactttaacttcccttctgaaggacatctggtacgaagcactggtcccggcgggagctttgccaagcacatggtagcccagtgtgtctcaccaaagggacctcttgcttgttcgagaacatacctttttggagctactcatgttccttacttgggtggtgacagcaagctgcccaagaaaactgaacaaattaggctattgtcccagatatatgctgctgttattgaggctgttttggctggcattgcatgttatgctaaaacttccagtctaacaaaggccaaggaggtagcagagcaaactctgggatctgggttagattcctttgagttgattccgtttaaggcagccctgcgctccaagatgacttttcatatacatgctgtgaataatcagggaagaattgtaccgctggacagtgaagatagcttatcctttgtgaagacggcttgtatggccgtctatgacattcctgacttactgggaggcaatggttgtttaggatctgtggttttctctgaatcatttttgacttctcagatcttagttaaagaaaaggatggcactgttaccacagaaaccagctccgtagtcctgactgctgctgtacccagattctgctcctggctggtggaagataatgaagtaaaattgtctgagaaaacccagcaagcagtgaggggggatgagtctttcctgggcacttatctaacaggaggagaaggagcatatctttattccagcaatctacagtcctggcctgaggaagggaatgttcatttcttctctagtggccttctgttttctcactgtcgtcatggaagtatcatcatttccaaggatcacatgaattccatttccttctatgatggggattccaccagtactgttgctgctcttctcatagacttcaaaagctcattgcttcctcacctcccagttcatttccatggatcaagcaattttctgatgattgcccttttccccaaatcgaagatataccaagcattttactcagaggtcttctccctctggaaacagcaggataactcagggatctctttaaaagtgatccaggaagatggattatctgtggaacaaaagagattgcactccagtgcacagaagctcttcagtgccctgagccagcctgctggggagaaacggagttccctaaagttactctcagccaaactcccagagctggactggtttctccagcatttcgccatcagcagcattagccaggagcctgtgatgcggacccatcttcctgtgctgctgcagcaagctgaaatcaacactactcacagaatagaaagtgacaaggtaattatcagcattgtaaccggcctcccaggctgtcacgctagcgagctctgtgcttttctggtcactctgcataaggaatgtggcagatggatggtgtatcgccaaatcatggacagctctgaatgttttcatgctgcacacttccagagatacctttccagtgccctagaggcccagcagaaccgctctgcgcgccagtcagcctacatccgcaagaagaccagactgctggtggtgttacaaggctacacagatgttattgatgttgtccaggccctgcagacccacccagactcaaatgtcaaggcctccttcaccattggtgccatcacagcatgtgtggagcccatgagctgctacatggagcacagatttctctttcctaaatgtcttgaccagtgttcacaaggcctggtgagtaacgtggtattcaccagtcacaccacggagcagcggcaccctctccttgttcagctgcagagcctcatcagggctgccaatcctgctgcagccttcattcttgcagaaaatgggattgtcaccaggaatgaagacattgagctgattctctcagaaaacagtttttcaagtcctgagatgctacgatctcgatatttaatgtatcctggctggtatgaaggtaaattgaatgctggatcagtctatcccctaatggttcagatctgcgtatggtttggccgtcccttggagaagactcgctttgtggccaaatgtaaagcaattcagtcctccatcaagccaagtcccttctccggaaacatctaccacatcctgggcaaagtgaagttttcagactctgagaggaccatggaggtctgctacaacacactggccaactccttgagcatcatgccagttttggaaggacccacaccaccaccagactccaaaagcgtatctcaagacagcagcgggcagcaggagtgctaccttgtgttcatcggctgctccctgaaggaagacagcatcaaggactggctgcggcagtcagctaagcagaagcctcagaggaaagccctgaagaccagggggatgctgacgcaacaggagatcaggagcatccacgtaaaacgccacttggaacccctacctgcaggctacttttataatggcacccaatttgttaacttctttggtgacaaaactgattttcacccactcatggaccagttcatgaatgactacgtggaagaagccaaccgggaaattgagaagtataaccaggagctggaacagcaggagtatcatgacctctttgagctgaagccctagaggaaggctgggcccgtacgtcctgcagaatgtccaccttggagatggacgaacgggtgtcttaacctcagctctgctggaggcctctcccttaaggggctgtctttgttctccttggcctgtgtgggctggcttgagtgcatgttgtctttattccctgtatagcgctgaagagcatcacctgcaccattgattttgggggtcgggggaatactcaaggatgagcagatggggcctgcccgtctacgtgtgcaactggcagtccaggagctctgggtttctgataacaggatctcctttgggctcttgaggttggggagaagcattaggattacacagaggagctactgggacttagaaggaaccctggctgcctgaactgtggccgtgtctgggaggcgaggccacgacaggcctcaagcctcagatgctgctccacgagagccatcttccccagtggagtgcctgcctcccctgctaggcccgtttccctgaaggagctggccgtactggccgtgggcccagtcctgggaggagcagcacagccttgcccaggcccagtccacagagccagcagcttgggttgagatgaatgatgtgttcacaaatgaggggatttcccttctggactaaactgaaggagaggcttgttgctttccagaggtgtgtggctcttaagttgacatcagcttttccccttgtgggtggttctttagctctcctgtcacaccattcgggtgtcctaatgtagggacaagagcaagcctgctgctcaggccccctggcgaggcttcacctcactgtggaagggggcgtcctgcagctggttagtcttaggcctggtggctgatcacttgtggggtcagtctccagcacccagcgctcccacaagccttgccaaggaaggcctgcttttcagccacaaacttcaggaaactcatccccccgctccccaaagtgttgttgctggccctgggcttgtgtggctcctgaggattgggaatttcaaataattgcaatacctgagttagaattccttctaatggcatcgttttaagctggaccataaagcagaggggaattacaagtgtgtcccatgcctgaccttcataattggtgtgggggacaggggagtcacagccactgatatttaggtgatgtctcttaggacttcagtgcctcagctgcctgaactgtaaatgttttctgaatttcacatatttttttttgcatgccttaggaagaagcacataggtaaaaccagcagtttccagtaatatagggggtttttgagcaaggcccctggagcagcggagagacaagatggagcacatgtagtctgtgtgcctggtcacacagaggcctgcatgcaagtagcaaagcagctctcaagggcttgtcagtaaaatatattaga

SEQ ID NO: 336065 - DNA, 1271 bp, Homo sapiens
attttataataccggagttttgctctatcactgtatcatggacagcaagcttatggaacttattcctcaaaaagtgggacatgctgaaaatacaaacctagcttgagtttagttatgtccctaaatgttaactgatccctgtgggtcagtagggagacagctggcatccgtttccaaccagccaaggatattcggtcgactgtactgactgaccactttgctcaggccgcaagtgtccctcagaaaagcctgaggacttattaaggtcatggaaggttgccttggccaggaactcttttctaatcacatgtttttgacttccctctctagccctaaccggcagccatttgttctctttggtaatcactccacacgagaaaacctgaatgctggcaactttaacttcccttctgaaggacatctggtacgaagcactggtcccggcgggagctttgccaagcacatggtagcccagtgtgtctcaccaaagggacctcttgcttgttcgagaacatacctttttggagctactcatgttccttacttgggtggtgacagcaagctgcccaagaaaactgaacaaattaggctattgtcccagatatatgctgctgttattgaggctgttttggctggcattgcatgttatgctaaaacttccagtctaacaaaggccaaggaggtagcagagcaaactctgggatctgggttagattcctttgagttgattccgtttaaggcagccctgcgctccaagatgacttttcatatacatgctgtgaataatcagggaagaattgtaccgctggacagtgaagatagcttatcctttgtgaagacggcttgtatggccgtctatgacattcctgacttactgggaggcaatggttgtttaggatctgtggttttctctgaatcatttttgacttctcagatcttagttaaagaaaagggtaagtatatgtgatctttagaaagcaaaccttaagcctttttttttttttttggcaaaataaactataaactaaggcaaaaggccaacaataaactggtaaaaatattagaactgatgatcacagcactgcactccagcctcagtgacacagtgagaccccgtctcaaaaaaaaaaaaaaagagaaacattaaagatgaacaaagggtgtataacctaatttatgaagaactcttccaaaattaataagaaaagataagctacccaatagtaaaatgagcaaaaaaaatgaacaggcacttcacagacgtggaaaac

SEQ ID NO: 336066 - DNA, 323 bp, Homo sapiens
ccaccctcagagctccaggatcgcctgcaggcttccttttacctccagagcagggtggttcttccctcactcttgcccagttatgaggactaatggaacttgggaatgtagaaacactgtagcttccaggggctgcatgtcatgaagtggagtgacaccaagggaccagattgcgggctcttccttttggttttctttccatccttgttcaatcagccattcgggattcccctcttcctccactttgcaatgccagtcagtgaactaatcattccttttttaccttccccagctacacagatgttattgatgttgtccaggcc

SEQ ID NO: 336067 - DNA, 646 bp, Homo sapiens
gtcacgctagcgagctctgtgcttttctggtcactctgcataaggaatgtggcaggttagtatggctgatgcctttgctttggggaaagggattctaacttgggcctgcctaggcactggaaaaccttagacatgtactggccttggtgggactggtatcagcatggtagtcagccattcatttaatatgctcttctgagcacttcctgtatggcaggcactgttctgagtatgagagaatacatcgatgaacatacagacacgaaaatctctgcacttatggagcttacattctagtttggtaagacaaacagataaggaaaagtatattaactagtgaaaagttctatggagaaaataaagcagagaaggggccaggtgcagtgtctcacacctgtaatcccagcactttgggaggcaaaagtgggtagatcgcctgagaccaggaatttgagaccagccttgacaacatggcaaaacctacaaaaatacaaaaattagccgaacgtggtggcatgcacctatagtcccagctactcgggaggctgaggtgggaggatcacttgaacctaggagggcgaggctgcggtgagctgagattgcgccactgcatcccagcctgggcaacagagtgagaccctgatta

SEQ ID NO: 336068 - DNA, 6298 bp, Homo sapiens
attttataataccggagttttgctctatcactgtatcatggacagcaagcttatggaacttattcctcaaaaagtgggacatgctgaaaatacaaacctagcttgagtttagttatgtccctaaatgttaactgatccctgtgggtcagtagggagacagctggcatccgtttccaaccagccaaggatattcggtcgactgtactgactgaccactttgctcaggccgcaagtgtccctcagaaaagcctgaggacttattaaggtcatggaaggttgccttggccaggaactcttttctaatcacatgtttttgacttccctctctagccctaaccggcagccatttgttctctttggtaatcactccacacgagaaaacctgaatgctggcaactttaacttcccttctgaaggacatctggtacgaagcactggtcccggcgggagctttgccaagcacatggtagcccagtgtgtctcaccaaagggacctcttgcttgttcgagaacatacctttttggagctactcatgttccttacttgggtggtgacagcaagctgcccaagaaaactgaacaaattaggctattgtcccagatatatgctgctgttattgaggctgttttggctggcattgcatgttatgctaaaacttccagtctaacaaaggccaaggaggtagcagagcaaactctgggatctgggttagattcctttgagttgattccgtttaaggcagccctgcgctccaagatgacttttcatatacatgctgtgaataatcagggaagaattgtaccgctggacagtgaagatagcttatcctttgtgaagacggcttgtatggccgtctatgacattcctgacttactgggaggcaatggttgtttaggatctgtggttttctctgaatcatttttgacttctcagatcttagttaaagaaaaggatggcactgttaccacagaaaccagctccgtagtcctgactgctgctgtacccagattctgctcctggctggtggaagataatgaagtaaaattgtctgagaaaacccagcaagcagtgaggggggatgagtctttcctgggcacttatctaacaggaggagaaggagcatatctttattccagcaatctacagtcctggcctgaggaagggaatgttcatttcttctctagtggccttctgttttctcactgtcgtcatggaagtatcatcatttccaaggatcacatgaattccatttccttctatgatggggattccaccagtactgttgctgctcttctcatagacttcaaaagctcattgcttcctcacctcccagttcatttccatggatcaagcaattttctgatgattgcccttttccccaaatcgaagatataccaagcattttactcagaggtcttctccctctggaaacagcaggataactcagggatctctttaaaagtgatccaggaagatggattatctgtggaacaaaagagattgcactccagtgcacagaagctcttcagtgccctgagccagcctgctggggagaaacggagttccctaaagttactctcagccaaactcccagagctggactggtttctccagcatttcgccatcagcagcattagccaggagcctgtgatgcggacccatcttcctgtgctgctgcagcaagctgaaatcaacactactcacagaatagaaagtgacaaggtaattatcagcattgtaaccggcctcccaggctgtcacgctagcgagctctgtgcttttctggtcactctgcataaggaatgtggcagatggatggtgtatcgccaaatcatggacagctctgaatgttttcatgctgcacacttccagagatacctttccagtgccctagaggcccagcagaaccgctctgcgcgccagtcagcctacatccgcaagaagaccagactgctggtggtgttacaaggctacacagatgttattgatgttgtccaggccctgcagacccacccagactcaaatgtcaaggcctccttcaccattggtgccatcacagcatgtgtggagcccatgagctgctacatggagcacagatttctctttcctaaatgtcttgaccagtgttcacaaggcctggtgagtaacgtggtattcaccagtcacaccacggagcagcggcaccctctccttgttcagctgcagagcctcatcagggctgccaatcctgctgcagccttcattcttgcagaaaatgggattgtcaccaggaatgaagacattgagctgattctctcagaaaacagtttttcaagtcctgagatgctacgatctcgatatttaatgtatcctggctggtatgaaggtaaattgaatgctggatcagtctatcccctaatggttcagatctgcgtatggtttggccgtcccttggagaagactcgctttgtggccaaatgtaaagcaattcagtcctccatcaagccaagtcccttctccggaaacatctaccacatcctgggcaaagtgaagttttcagactctgagaggaccatggaggtctgctacaacacactggccaactccttgagcatcatgccagttttggaaggacccacaccaccaccagactccaaaagcgtatctcaagacagcagcgggcagcaggagtgctaccttgtgttcatcggctgctccctgaaggaagacagcatcaaggactggctgcggcagtcagctaagcagaagcctcagaggaaagccctgaagaccagggggatgctgacgcaacaggagatcaggagcatccacgtaaaacgccacttggaacccctacctgcaggctacttttataatggcacccaatttgttaacttctttggtgacaaaactgattttcacccactcatggaccagttcatgaatgactacgtggaagaagccaaccgggaaattgagaagtataaccaggagctggaacagcaggagtatcatgacctctttgagctgaagccctagaggaaggctgggcccgtacgtcctgcagaatgtccaccttggagatggacgaacgggtgtcttaacctcagctctgctggaggcctctcccttaaggggctgtctttgttctccttggcctgtgtgggctggcttgagtgcatgttgtctttattccctgtatagcgctgaagagcatcacctgcaccattgattttgggggtcgggggaatactcaaggatgagcagatggggcctgcccgtctacgtgtgcaactggcagtccaggagctctgggtttctgataacaggatctcctttgggctcttgaggttggggagaagcattaggattacacagaggagctactgggacttagaaggaaccctggctgcctgaactgtggccgtgtctgggaggcgaggccacgacaggcctcaagcctcagatgctgctccacgagagccatcttccccagtggagtgcctgcctcccctgctaggcccgtttccctgaaggagctggccgtactggccgtgggcccagtcctgggaggagcagcacagccttgcccaggcccagtccacagagccagcagcttgggttgagatgaatgatgtgttcacaaatgaggggatttcccttctggactaaactgaaggagaggcttgttgctttccagaggtgtgtggctcttaagttgacatcagcttttccccttgtgggtggttctttagctctcctgtcacaccattcgggtgtcctaatgtagggacaagagcaagcctgctgctcaggccccctggcgaggcttcacctcactgtggaagggggcgtcctgcagctggttagtcttaggcctggtggctgatcacttgtggggtcagtctccagcacccagcgctcccacaagccttgccaaggaaggcctgcttttcagccacaaacttcaggaaactcatccccccgctccccaaagtgttgttgctggccctgggcttgtgtggctcctgaggattgggaatttcaaataattgcaatacctgagttagaattccttctaatggcatcgttttaagctggaccataaagcagaggggaattacaagtgtgtcccatgcctgaccttcataattggtgtgggggacaggggagtcacagccactgatatttaggtgatgtctcttaggacttcagtgcctcagctgcctgaactgtaaatgttttctgaatttcacatatttttttttgcatgccttaggaagaagcacataggtaaaaccagcagtttccagtaatatagggggtttttgagcaaggcccctggagcagcggagagacaagatggagcacatgtagtctgtgtgcctggtcacacagaggcctgcatgcaagtagcaaagcagctctcaagggcttgtcagtaaaatatattagaaaaaaaaaaaaaacaatttgaagccaaatgaacaaaactccagataccattgataagaaattttggcatcaagaagggcttctgaaaagacccacgtgctccagtcccagctccaaaagccactgatgacaagggccccactgtggaacctaagtctgggagccccctgacttctggctggccagaggctgcggtccgtcaagggcttgcctcgcttcagaatcagtaacatagatcttaagtgcaattgattaataagcagtgagttactgtagcttcctttagctctaccgaactctttttaaaaactcaaacttgagcagccttagaaaaggggttggggggtgggaaccacaggccatttctctaagtgggctgctgtgaagttttaaatgaaagctctagctttaggagcttgagccatttcctgactgcactggcctggcagtctggctgctgcacaagagtttttaaagaggggtcggagcccgcccgtgagagcgggtcttctcaccatgtggggctgtactacgtggtggtcttggtttctcttcacagaaatgctctctcaccaacttgccccactgtcccaactcctctcctcttagagaaaaaactgtgattacctcaacttgaatatgaaactgtgattgaaaaaagtcaaaacgtgaagaagcatcaaagccaaaaaggcaaaactggctgaggcctctgttgatgctcctcagcctactcgggaacgtgaaggggcagctggcgaaagggcattcctggggccacttgctctgccccactgataaggcacacccgcggtgcactgtgagctctttgaggactgaggccaggggatgcctcctggaacctgccaggcctctctgttctgtgaaggtcagtatccacttgattcctccaggcggcgctccaggtgggaggagcagggtcttctgctgtttccaaaggaatggccatgacactgcttttgaccttagaagtggatccagggacccagcaaagagcgggggtgggttcccagggacaggcagtcctcccggggcttacatgctttttgctaactttcctattagcagcttcagtttatatcacccagagtgcgtgggataatgttgaagtcgctgaagttacgggttattttatgtttttacatgggatttttctgtttttgattggaagaaggagacagaaattggaggaaatgggattattatcctagggaagggccgttggcaaggagttgagccggcccctctgagccctgggggctatctgacctgaagcctggacactgggcccttcaggtcgcaagaaaaagttccctcctaaattctattaggattttggagaatttttgcacagtaagaagctctgggttgctccttgggcttctcaaaagggaaaagttcaattcaaagattgtaaactacgaagtattccagccgtgttgctgatctagttggatagttgtacctcaaaaaagtaggtgagaactggcttcctcattgtcccaggatgtcaaatactaatgacataagagctcacttacgtgccaaaattcacttttatactagtttttcagtgctttaatatttgtaacttaaattttaaaactcgtatttacaaacactactgtaacttcagtgaaactgaattgtgcgattgaagctttttgcttatcatagtatttattacactacttaattcagtaaatatataaaagtagccttcaatttatttttatattattttacatgtttttacctgcagttgtgtatgtgaatttaccttggtaatcgagatgtcatgctaaggaccaataaactatcactgaacaaaaaaaaaaacca

SEQ ID NO: 336069 - DNA, 2970 bp, Homo sapiens
acttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcactgttctcagctaacagtaactccagtttactgagagaacattcaattgacggcactggctgggctcccatgagaacattaaaggatgtcgtttggggattaaactctttgtttactgatttttgaattttgatgatccactgaatattgaagctgcagaacatcatttgcaggacaaggtgagaattctatttggtgcacgtgctattgtgtccggaattggtgggttcttggtctcactgacttcaagaatgaagccgcggaccctcgcggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccggacctcaaagggacacacaggtgggcaccacagcccagtgaagggggccaagccccatttcattacttcctcggtggaacacgactccatccggctgcccctggagcacctggtggaagaacaagtggcagcggtcaccttgtcccggtgtccaaggtgagcgggcaggcagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggccgcggagctggtgacccagaactgcgaggcttatgaggcccacatgagggacgtccgcgactacctggaagagaggctggaagctgaattcggtcagaagagaatccatctgaatagccagtttccaggcacccagcggcttcccaatacctgtaacttttccatccggggaccccggcttcaaggccacgtggtgcttgcgcagtgccgagtgctgatggccagtgtgggggccgcgtgccactcggaccacggggaccagccgtccccagtgctgctgagctacggtgtccccttcgacgtggccaggaacgcgctccggctcagcgtgggccgcagcaccaccagggccgaggtggacctcgtcgtgcaggacctgaagcaggccgtggcgcagctggaggaccaggcctagcactggggccgccttccccaccccgcttctgggaagcccgtggcagggcacagggttgtccctccagttccctcctgagggctgtgccaggatgactgtctcatgccccctctgcattttgtcctggagtgccagcgagtgtgcacccccagtttccttccctggacccctgcagagctcacagggcccaggacaccaacgccgcataggactgcccacatgggaccgcccacataggaccgcccacataggaccgcccacatgggaccgcccacatgggaccgcccacatgggaccgcccacatgggaccgcccacatgggagcgcccacatgggaccgcccacatgggaccgcccacatgggaccgcccacatagaaccgtcctccagtggtgaagcggaaacacttagctttatccaccctccccactgggaactgggcacgcctgttgtgagtgccctttcctggaaggtgtttttatctggaagatagaatccaagtatttataactcattgtcagccaaatgctatcatgaacgtaggaaacttgatttttttgttttgatcatggcctctacatgcacctttccagagtggtctcttctcaggccctttttagtccctttccaaagctgcccccaccaccctgctcctctggcctcagtgcacagtggcccccagcctcggccaggcctgctctgctcagcgcccaccgcccaccacccctcctgcttccccgagcctgaccctgttccgcccactggcaatcagggctgcgcacttccctgtccacggtccccaggccttcctgtcttgtcccttttgatcattattaactcagggtttcagctccaacctcgctgagttggtgcagctccaggtcattcctggggtgggaatcggatcatccctgactcagcttttaccttaattttatttgcagaggattcttttctcaaaatgctctggcatttggacacacatcacatgtcgatatttgcataggagtcattttcagtggaataacatttttaatgtgtggttttacggttcaaggaactacttgatgattttgaggaaacacttgccagaaactaaattaacgaataaaagatttcagtgcccg

SEQ ID NO: 336070 - DNA, 5984 bp, Homo sapiens
attttataataccggagttttgctctatcactgtatcatggacagcaagcttatggaacttattcctcaaaaagtgggacatgctgaaaatacaaacctagcttgagtttagttatgtccctaaatgttaactgatccctgtgggtcagtagggagacagctggcatccgtttccaaccagccaaggatattcggtcgactgtactgactgaccactttgctcaggccgcaagtgtccctcagaaaagcctgaggacttattaaggtcatggaaggttgccttggccaggaactcttttctaatcacatgtttttgacttccctctctagccctaaccggcagccatttgttctctttggtaatcactccacacgagaaaacctgaatgctggcaactttaacttcccttctgaaggacatctggtacgaagcactggtcccggcgggagctttgccaagcacatggtagcccagtgtgtctcaccaaagggacctcttgcttgttcgagaacatacctttttggagctactcatgttccttacttgggtggtgacagcaagctgcccaagaaaactgaacaaattaggctattgtcccagatatatgctgctgttattgaggctgttttggctggcattgcatgttatgctaaaacttccagtctaacaaaggccaaggaggtagcagagcaaactctgggatctgggttagattcctttgagttgattccgtttaaggcagccctgcgctccaagatgacttttcatatacatgctgtgaataatcagggaagaattgtaccgctggacagtgaagatagcttatcctttgtgaagacggcttgtatggccgtctatgacattcctgacttactgggaggcaatggttgtttaggatctgtggttttctctgaatcatttttgacttctcagatcttagttaaagaaaaggatggcactgttaccacagaaaccagctccgtagtcctgactgctgctgtacccagattctgctcctggctggtggaagataatgaagtaaaattgtctgagaaaacccagcaagcagtgaggggggatgagtctttcctgggcacttatctaacaggaggagaaggagcatatctttattccagcaatctacagtcctggcctgaggaagggaatgttcatttcttctctagtggccttctgttttctcactgtcgtcatggaagtatcatcatttccaaggatcacatgaattccatttccttctatgatggggattccaccagtactgttgctgctcttctcatagacttcaaaagctcattgcttcctcacctcccagttcatttccatggatcaagcaattttctgatgattgcccttttccccaaatcgaagatataccaagcattttactcagaggtcttctccctctggaaacagcaggataactcagggatctctttaaaagtgatccaggaagatggattatctgtggaacaaaagagattgcactccagtgcacagaagctcttcagtgccctgagccagcctgctggggagaaacggagttccctaaagttactctcagccaaactcccagagctggactggtttctccagcatttcgccatcagcagcattagccaggagcctgtgatgcggacccatcttcctgtgctgctgcagcaagctgaaatcaacactactcacagaatagaaagtgacaaggtaattatcagcattgtaaccggcctcccaggctgtcacgctagcgagctctgtgcttttctggtcactctgcataaggaatgtggcagatggatggtgtatcgccaaatcatggacagctctgaatgttttcatgctgcacacttccagagatacctttccagtgccctagaggcccagcagaaccgctctgcgcgccagtcagcctacatccgcaagaagaccagactgctggtggtgttacaaggctacacagatgttattgatgttgtccaggccctgcagacccacccagactcaaatgtcaaggcctccttcaccattggtgccatcacagcatgtgtggagcccatgagctgctacatggagcacagatttctctttcctaaatgtcttgaccagtgttcacaaggcctggtgagtaacgtggtattcaccagtcacaccacggagcagcggcaccctctccttgttcagctgcagagcctcatcagggctgccaatcctgctgcagccttcattcttgcagaaaatgggattgtcaccaggaatgaagacattgagctgattctctcagaaaacagtttttcaagtcctgagatgctacgatctcgatatttaatgtatcctggctggtatgaaggtaaattgaatgctggatcagtctatcccctaatggttcagatctgcgtatggtttggccgtcccttggagaagactcgctttgtggccaaatgtaaagcaattcagtcctccatcaagccaagtcccttctccggaaacatctaccacatcctgggcaaagtgaagttttcagactctgagaggaccatggaggtctgctacaacacactggccaactccttgagcatcatgccagttttggaaggacccacaccaccaccagactccaaaagcgtatctcaagacagcagcgggcagcaggagtgctaccttgtgttcatcggctgctccctgaaggaagacagcatcaaggactggctgcggcagtcagctaagcagaagcctcagaggaaagccctgaagaccagggggatgctgacgcaacaggagatcaggagcatccacgtaaaacgccacttggaacccctacctgcaggctacttttataatggcacccaatttgttaacttctttggtgacaaaactgattttcacccactcatggaccagttcatgaatgactacgtggaagaagccaaccgggaaattgagaagtataaccaggagctggaacagcaggagtatcatgacctctttgagctgaagccctagaggaaggctgggcccgtacgtcctgcagaatgtccaccttggagatggacgaacgggtgtcttaacctcagctctgctggaggcctctcccttaaggggctgtctttgttctccttggcctgtgtgggctggcttgagtgcatgttgtctttattccctgtatagcgctgaagagcatcacctgcaccattgattttgggggtcgggggaatactcaaggatgagcagatggggcctgcccgtctacgtgtgcaactggcagtccaggagctctgggtttctgataacaggatctcctttgggctcttgaggttggggagaagcattaggattacacagaggagctactgggacttagaaggaaccctggctgcctgaactgtggccgtgtctgggaggcgaggccacgacaggcctcaagcctcagatgctgctccacgagagccatcttccccagtggagtgcctgcctcccctgctaggcccgtttccctgaaggagctggccgtactggccgtgggcccagtcctgggaggagcagcacagccttgcccaggcccagtccacagagccagcagcttgggttgagatgaatgatgtgttcacaaatgaggggatttcccttctggactaaactgaaggagaggcttgttgctttccagaggtgtgtggcttcctgaggattgggaatttcaaataattgcaatacctgagttagaattccttctaatggcatcgttttaagctggaccataaagcagaggggaattacaagtgtgtcccatgcctgaccttcataattggtgtgggggacaggggagtcacagccactgatatttaggtgatgtctcttaggacttcagtgcctcagctgcctgaactgtaaatgttttctgaatttcacatatttttttttgcatgccttaggaagaagcacataggtaaaaccagcagtttccagtaatatagggggtttttgagcaaggcccctggagcagcggagagacaagatggagcacatgtagtctgtgtgcctggtcacacagaggcctgcatgcaagtagcaaagcagctctcaagggcttgtcagtaaaatatattagaaaaaaaaaaaaaacaatttgaagccaaatgaacaaaactccagataccattgataagaaattttggcatcaagaagggcttctgaaaagacccacgtgctccagtcccagctccaaaagccactgatgacaagggccccactgtggaacctaagtctgggagccccctgacttctggctggccagaggctgcggtccgtcaagggcttgcctcgcttcagaatcagtaacatagatcttaagtgcaattgattaataagcagtgagttactgtagcttcctttagctctaccgaactctttttaaaaactcaaacttgagcagccttagaaaaggggttggggggtgggaaccacaggccatttctctaagtgggctgctgtgaagttttaaatgaaagctctagctttaggagcttgagccatttcctgactgcactggcctggcagtctggctgctgcacaagagtttttaaagaggggtcggagcccgcccgtgagagcgggtcttctcaccatgtggggctgtactacgtggtggtcttggtttctcttcacagaaatgctctctcaccaacttgccccactgtcccaactcctctcctcttagagaaaaaactgtgattacctcaacttgaatatgaaactgtgattgaaaaaagtcaaaacgtgaagaagcatcaaagccaaaaaggcaaaactggctgaggcctctgttgatgctcctcagcctactcgggaacgtgaaggggcagctggcgaaagggcattcctggggccacttgctctgccccactgataaggcacacccgcggtgcactgtgagctctttgaggactgaggccaggggatgcctcctggaacctgccaggcctctctgttctgtgaaggtcagtatccacttgattcctccaggcggcgctccaggtgggaggagcagggtcttctgctgtttccaaaggaatggccatgacactgcttttgaccttagaagtggatccagggacccagcaaagagcgggggtgggttcccagggacaggcagtcctcccggggcttacatgctttttgctaactttcctattagcagcttcagtttatatcacccagagtgcgtgggataatgttgaagtcgctgaagttacgggttattttatgtttttacatgggatttttctgtttttgattggaagaaggagacagaaattggaggaaatgggattattatcctagggaagggccgttggcaaggagttgagccggcccctctgagccctgggggctatctgacctgaagcctggacactgggcccttcaggtcgcaagaaaaagttccctcctaaattctattaggattttggagaatttttgcacagtaagaagctctgggttgctccttgggcttctcaaaagggaaaagttcaattcaaagattgtaaactacgaagtattccagccgtgttgctgatctagttggatagttgtacctcaaaaaagtaggtgagaactggcttcctcattgtcccaggatgtcaaatactaatgacataagagctcacttacgtgccaaaattcacttttatactagtttttcagtgctttaatatttgtaacttaaattttaaaactcgtatttacaaacactactgtaacttcagtgaaactgaattgtgcgattgaagctttttgcttatcatagtatttattacactacttaattcagtaaatatataaaagtagccttcaatttatttttatattattttacatgtttttacctgcagttgtgtatgtgaatttaccttggtaatcgagatgtcatgctaaggaccaataaactatcactgaacaaaaaaaaaaacca

SEQ ID NO: 336071 - DNA, 1809 bp, Homo sapiens
attttataataccggagttttgctctatcactgtatcatggacagcaagcttatggaacttattcctcaaaaagtgggacatgctgaaaatacaaacctagcttgagtttagttatgtccctaaatgttaactgatccctgtgggtcagtagggagacagctggcatccgtttccaaccagccaaggatattcggtcgactgtactgactgaccactttgctcaggccgcaagtgtccctcagaaaagcctgaggacttattaaggtcatggaaggttgccttggccaggaactcttttctaatcacatgtttttgacttccctctctagccctaaccggcagccatttgttctctttggtaatcactccacacgagaaaacctgaatgctggcaactttaacttcccttctgaaggacatctggtacgaagcactggtcccggcgggagctttgccaagcacatggtagcccagtgtgtctcaccaaagggacctcttgcttgttcgagaacatacctttttggagctactcatgttccttacttgggtggtgacagcaagctgcccaagaaaactgaacaaattaggctattgtcccagatatatgctgctgttattgaggctgttttggctggcattgcatgttatgctaaaacttccagtctaacaaaggccaaggaggtagcagagcaaactctgggatctgggttagattcctttgagttgattccgtttaaggcagccctgcgctccaagatgacttttcatatacatgctgtgaataatcagggaagaattgtaccgctggacagtgaagatagcttatcctttgtgaagacggcttgtatggccgtctatgacattcctgacttactgggaggcaatggttgtttaggatctgtggttttctctgaatcatttttgacttctcagatcttagttaaagaaaaggatggcactgttaccacagaaaccagctccgtagtcctgactgctgctgtacccagattctgctcctggctggtggaagataatgaagtaaaattgtctgagaaaacccagcaagcagtgaggggggatgagtctttcctgggcacttatctaacaggaggagaaggagcatatctttattccagcaatctacagtcctggcctgaggaagggaatgttcatttcttctctagtggccttctgttttctcactgtcgtcatggaagtatcatcatttccaaggatcacatgaattccatttccttctatgatggggattccaccagtactgttgctgctcttctcatagacttcaaaagctcattgcttcctcacctcccagttcatttccatggatcaagcaattttctgatgattgcccttttccccaaatcgaagatataccaagcattttactcagaggtcttctccctctggaaacagcaggataactcagggatctctttaaaagtgatccaggaagatggattatctgtggaacaaaagagattgcactccagtgcacagaagctcttcagtgccctgagccagcctgctggggagaaacggagttccctaaagttactctcagccaaactcccagagctggactggtttctccagcatttcgccatcagcagcattagccaggagcctgtgatgcggacccatcttcctgtgctgctgcagcaagctgaaatcaacactactcacagaatagaaagtgacaaggtagaggagctcaccagatatgctgggaattcacaggaagatgatcttgagagcctgcccctgaatcttttgtgtcagttaacaaa

SEQ ID NO: 336072 - DNA, 214 bp, Homo sapiens
gggaagagagctgagggtctatgagaggtagtgattataatgatcgactggaatttcagctgagttaggaggacatctgaggttgaggatcagcagatgggcattcccaggggattgttggagtcagaataccacatggtatgagttggaaagataggatgtggtggtctgagaatggaggagttgccattattagtaagcttaaggtaggaag

SEQ ID NO: 336073 - DNA, 388 bp, Homo sapiens
atgtgtgtgttgggagagagggagagggcagccctccacctcaggctggggcaggctggagtgaaggtccaagcgctggacccgagcagcagcctcagccccaatctaaaagctcagcccgttttcccatgcatacaatgggcataactgtcccaagaatgaggcttgctggagttactggcaagctgcgcgctgtccgcctaattcacctaattcagggcaagaaccgctctctggcccctgcacctgggagaggtggggtgctggaccgagggcgaagtaacagcgtcctgagggcccatccccaaatcgccttccttagggaagccggaacaaacgatgcagcggggcggccctggatctgttccttcctaagagctggagcagg

SEQ ID NO: 336074 - DNA, 738 bp, Homo sapiens
gtggtgcctggtccttcctatcttttaattggaaaagatcactatgatatattaagtgaaaaaagacaaagtacaagttatatatatggtatatgccaccttttgaataaggaaaaaaagagcataaaggaagaaagacaagaacacgggatataaacaatggcaaagtcaaaacacaagagaggcaaagggatctcccaggagcatggttaggaggaattccagagtgacacctatacatcagatatgagaggtaaagaacccagattggagcaatgagacttatgaatcagaaatattgtcaacaccaacatccccttctgccattataacatgcttttaatctaagaacacaatattatatggagaaggaggtgatcacattcttattctcgctccatgccctgctgcctggataagcagaagacactcatgacccccagaattgttctgctgtgtatgatttatgtttcttctgtgtatgatatatgttttttaacacatcctcctccaacaattgtgaaaccgagtttcacttattactaactggcctgtgattaacacattatatttcctataactgttcactgtcctcaagcatattttgaaaattaatacaagattcaaaacacttaaatattttacaaagtaggggataaaagcaaacataaagcaattcataccgtgtgacacaagtcctgaaatacacttatatactataaagaaatcaaacaataa

SEQ ID NO: 336075 - DNA, 494 bp, Homo sapiens
gtatttattctcctcttgtgtgccagttccatagaggatgtatagatgtgaaaatgtgtggaggatatagattgatcagtaaggagagaattctttcaatttatacgtttccatgtaatttgatttcttttttccaactaacatctatttaagattgaaaagggaatgtggagaaataagttgtattaagatagtagaaataggctgggcgcggtggctcacgcctgtaatcccagcactttgggaggccgaggcgggcggatcacgaggtcaggagatcgagaccatcctggctaacatggtgaaaccccgtctctactaaaaatacaaaaattagctggacatgatggcgggcacctgtagtcccagctactaaggaggctgaggcaggagaatggtgtgaacctgggaggcggagctttcagtgagccaagatggcgccactatactccagcctgggcgacagagcgagactccatttcaaaaaaaaaaag

SEQ ID NO: 336076 - DNA, 341 bp, Homo sapiens
cgtgtcatgcatgtcgaactcctgagctcaggcagtctgcccgcctcggtgtcccaaagtgctaggattataggcgtgagccactgctcccggcctagaaatgtattctcactgtattgctcaggctggtctcaaactcctggcctcaagcagtcctttcactttagcctcccaaagtggtaggattacaggtgtaagccaccacacctgaccaataaggaatctttttaaaaggggctaggaataacccataatactgtctttcttaatacatgtggcagttgggttaaatcttttaatagttcccatagtatgtctcctgcgtgctcattgttttgaag

SEQ ID NO: 336077 - DNA, 201 bp, Homo sapiens
tgagcctctggtttactgtttgatagaaatgaaaatatgtgtataaattaccattaatttcaggacacagtatgccaccctacaattaacttaaaattttgggccaggtacagtagctcacgcctgcaatcccagcactttgggaggccaaggcagggggatcgcttgagcccaggagtcccagaccatcctggctaatat

SEQ ID NO: 336078 - DNA, 303 bp, Homo sapiens
gtgatctagaggatcccgcgaaatcctcctcctcctgaattccttcctcctcttcctccttggaaagcaggtaggggactgcaaacacatactgcaaatagaagacttgatcatctgttctgagcttacagtgaagttgtgaactgactctgctacttttcagagatagtctaagtcaatacttaagaatttgggggccgagagtagtggctcacgcctgtaattcaacacttctggaagctgaggtgggagaattgcttgagactgggagtttgagactagcttgagcaacaaggcaatacc

SEQ ID NO: 336079 - DNA, 1851 bp, Homo sapiens
ggccgttactttactattccgtggtcctcccttggggccctccccgtgtgtgatgtgctccccggtgttgtgctctcctgtatgtccacatttgggctttttgtcgcacgtgcgcgtgcgggtgtcgcccgccggggccggtctcttactatttgtgtgtgggatcgctccctctcgccgctttcgttgcttgtcccccgggggttctcctttggtactaccgcctttgcccctcgttctcgttatgccgcgatctggggccccggtggccccatcgtctggtgttgtcagcagcgtctttttcgcgaggttcgcgttgggggcccaagagtgttgtttggttggggttggtttgtttgtgtttgttttgtagtttcattacctacatactatgagtagtaattattgtttatttcaaaaaattgcattctttatgttttatatatcaacagtctttacacataatgaatgcatgtatatttttctttgattttttttcccagtagccagagtctgtagccttaataaaattatccaaaaataagtattgaaattcctataaataaggttttttttaaatatttattttttgtgacagagtctcgctcttttactggagtacagtgacatgatcttggctccctgcaacctccatctcctgggttctagcgattctcatgcctcagcctcccaagtagctgggattacaggcgtgcgccaccatgcccggttgatttttctatttttagtagagatggggttttgccatattgtccaggctggtcttgaactcatggcctcaagtgatctgcccaccttggcctcccaaagtgctgggattacagatatgagccactatgcccagcctattttatgttgtaaattgagtgatttaaggggatgtatgatgtaatataaagtgaataggtacattttgctttaattttttaaaaattatattactgtattttaataagtatatttttaaattaaagacagagtctcactatgttgtccaggctggtcttgaacctctgacctcaagtgattctcttgccttggcctgtcaaagtgctgggattataggcatgagccaccatgccccgctaaatttagctttatttgttatattttatgacaagtttgtaaccataaagaacacaaaaatttttttcttaagttttcaattaagttacttgtaaaaaggctgaaaacacatactaatcttcctatgtctattaattaatgaattaatttattaaatattctttctgaaaacatttcttagtccttgctttaaagaaccacaactgtgattctcacaggcatgtttataaactttactaattgcatgactagcttatttcacaggtgagaatgatcagtatacatgaataataattttttttagagaaattttaattgtattactattacataaccaagtaattttggagtttagatttaacattttggggaaaaaaacacttgacatataaatttatagattctgatacattttaacaaaaaatttaagttgtttttgccattcttaagaagctcccccttttcctttttcacgtactacaccaagtgaccatgcctccttggaaagcaggtaggggactgcaaacacatactgcaaatagaagacttgatcatctgttctgagcttacagtgaagttgtgaactgactctgctacttttcagagatagtctaagtcaatacttaagaatttgggggccgagagtagtggctcacgcctgtaattcaacacttctggaagctgaggtgggagaattgcttgagactgggagtttgagactagcttgagcaacaaggcaatacc

SEQ ID NO: 336080 - DNA, 193 bp, Homo sapiens
agattataatagctaacctcaatggggactgctggttctccagattttacccaagatatggaccctggagcacaggaaggtgcagtgagctgggtgtgttgctctgttgcagagctggggggtccccaggctgcttccctctcggggcagtgcgtgtttgtaggcatggttttttttccagtgagtttttttc

SEQ ID NO: 336081 - DNA, 497 bp, Homo sapiens
aatagtaactttgaaactgttgaatcaagtataagattgctgtttattatctggatacaaactccttacatgagggaagaaatgtttgttgttcttgttgtttttagtttttgctgaatttaaaccataggcaaatggacaaataccacttgcctaatgagtggaggactgaaaatgtgaattccactccaacatcccaccaggaactcttaaaataaaagacaaaccagaaaaccccctcgcctaagaatatgtctcatgtatcagccaaactctgaacctttttgaagaagagatacgtttccacagttatgctcagggatggtgcctttaattgatgtgaaacctgatctaacttaaaagaactgatctacttcaaaggaaaagctagtcctctctgattctgccacttccattaatgagaaataaataataattgttttgccgcaaaagaccttccccatattgtgaaacaacctttacctacaaggagaaga

SEQ ID NO: 336082 - DNA, 349 bp, Homo sapiens
acaaaataattatcctagagcaaggttttatgtaattaagtaatgtaattttatgtaattaagtaatgttatcctagaatagagatagttgtgtcaataaaaagcacgtaaatttgataatggatttgctttgtgcaaaactgaataggtaggaattccttttctagaaaaaataagatgaagaatcatgtaacacattttctatactgtgcaactagtaaaatgtaaaaataatatttataatagaaattagcttgctctatctaacaagaattcctttgcctggaaaaaaaaagtgttttcataatatgttactaaattgttaaaactcaggttacaaagtaggata

SEQ ID NO: 336083 - DNA, 467 bp, Homo sapiens
agggttgtgatcactcaaatcttgaccaaagtcagatatagggccaaatattttagaacaagatagggccccgctttggtaactgaaaaaaaacgaaactcagcttcttgaagctttgactgatttgcccttctggctacactgcctttgacacctgagcctacttataaccaattcctatagcaaccactgtgggagcctaggacaatggaggaccatcctggtttcaccagatcactactaggggaaccagggggccttccttcccacactcaagactgcctggacatgaacatatcctctgcctgacttccaaagcccgccacaaactacacctgactctctaaccacctctctccaagatcaccttttgctgcacttggtagttctatccacagctccctgcacacactgggcttgttatcattcctggacccacctcacgctgtttcctccctgtccccatc

SEQ ID NO: 336084 - DNA, 201 bp, Homo sapiens
tcgtgaataggacttgtgctttcataaaaagagatattaaagagctcgttgcctgttcctgtttccaccatgtcaggacacggcaggaagatggctgggctaaaccatgaagaatgctctcaccaggaaccaatttggctggcaccttgctcttggatttcccactttccaaattcatgagaaataaatttctgtgtctga

SEQ ID NO: 336085 - DNA, 229 bp, Homo sapiens
ggccccaggcccctgtgactcagcccagagacctggcgcaacccgggcttgggaatcccgttaacccacttcccgaaagctgtgaatcagataaggaaactgaggcagcttagggcggttaagtgacttgcccgagattgctgggtgagtggtggagccggacctgcaccccaacactgggggtggctgctgggactgccctcatggaggcttcgggagcctggaggag

SEQ ID NO: 336086 - DNA, 293 bp, Homo sapiens
catggcgggaggtggtggcgaggggacaagtagtgagatgagcaaataaaagctatttctgtgcattgtggtcactgtggccataggaggggtcccaaagccagatgaaggacccaaagccaggccacagagtacatctgtcctgtgcatgcactgcaaaaagacacctagcaaagggagctaggaagctgaaaggcagtctgtgacctccttcatggtttcctgtatctgccaaaagtgggtacctttttctgatttgcacaaaggctagtggtggccctgtaggtatggcc

SEQ ID NO: 336087 - DNA, 549 bp, Homo sapiens
tggggagcttgaggcttacagatagcagttattcctttggtgcttattttgcagggcactattataggaagcaagcaccttcttaacacaggtatagggaactaatttttggttacatagctgggggtgattcctgttatcagaaaaaattccaaaatgcatacatgagtaggcacttcaaaacactcagaaagtaggccagatcacagttatgttaaaaattagcatgtagacacttaaaggatttagttttttttacattgaaactaacatcatgaaaaacttgtgtttgcggtagttctgttacactgacaaggtcatatgtgatatgatttcagattagtatttttctacaaatgaataggtttctggttttaatgactgtgccagagaactttatgtggatattttcatttaatctttaccataccctgagggcagatcatgtcattaacagattaggacactagggcttcaaaatagttggtaagctgtccagttagcaaagcaggtactccacatctgctggggtccaggagcagctcagat

SEQ ID NO: 336088 - DNA, 618 bp, Homo sapiens
actgggaagctcctagtcaaattctgatgatcatttttatcacttaactttattcttctgactttttgcaacacttttcgggggtcagatataatctttgaaatattccttccatcccacatctaaattaacccacgtttagtagcattcaatgaggattactcctcaaccccattcttttctggctctggggtgacacttctgtgttctctaagtcattcagtccaccttttgtttgtcctctcttatttaaccttggtcttgccttcataacatcctggtattcatctcctccattcccactatctatccgtctttgcacatgtcattatagtgacctcctaacttatttcccttttcatcgtcctattgtttgcccaagcctgcttaattttgttgaatattcattaaatacaaggcttccctgctccctaaatttgtttgtcctctcttatttaaccttggtcttgccttcataacatcctggtattcatctcctccattcccactatctatccgtctttgcacatgtcattatagtgacctcctaacttatttaaccttggtcttgccttcatcacatcctgctattcatctcgtccatcccactcgctctgc

SEQ ID NO: 336089 - DNA, 1388 bp, Homo sapiens
actgggaagctcctagtcaaattctgatgatcatttttatcacttaactttattcttctgactttttgcaacacttttcgggggtcagatataatctttgaaatattccttccatcccacatctaaattaacccacgtttagtagcattcaatgaggattactcctcaaccccattcttttctggctctggggtgacacttctgtgttctctaagtcattcagtccaccttttgtttgtcctctcttatttaaccttggtcttgccttcataacatcctggtattcatctcctccattcccactatctatccgtctttgcacatgtcattatagtgacctcctaacttatttcccttttcatcgtcctattgtttgcccaagcctgcttaattttgttgaatattcattaaatacaaggcttccctgctccctaaatttgtttttcgttgcctactgagaattttccagactcacatcatgcctaagaaaggaagctgaataccttgttgtttcatcccatttctcttggtggttcccgtaaataccttattttttcccaaattaaatataaactttgtgtctccggaataccatagatatcatatcttgggaggatggataacttaatacaactgttaaaattctgctgcacataatgtgcgttttgcatttatatcagttgggcactatattctaatgacattttcaaatactgtgaacttaaagagttgaaaacagtcacatatgtcttcatggattctcaaacagtatttggatgttgtacgtcctaaataagatttttttgcctgctatctaacacctgagtaatatatgttctgtccaactgcataagtcatctctctagtcctagaatagccacacactttaaggaagattattcttattcaggcttatctgatatttggtagacttatgtacttttaaaatctaattttgacatctccatgtgcagactaacaaccttgtctttttaaaaatggtttcctggttggtcacggtggctcacacctgtaatcccagcactttgggaggcctaacatgggaggatagcttgagctccaggagttggaggctgtagtaagctatgattgcaccactgccctccagtctgttgctacagagcaagacctcaactcttgaaaaagtaataaaataagaggtttcccagtgaagatggtctcttattttaccatgttgtcttaaggtgcagttttaatggcgatatatagcttgttttatttagcatttctgattctacttactgtattaggaaattatatcctgaactgccaaagtattttaaacagtgggggaagcatgggagaaaataggttcccttccttcaactgccaaaaagtaaaatcaa

SEQ ID NO: 336090 - DNA, 655 bp, Homo sapiens
gctggtctggaactcttgagctcaagcagtcctcctgcttcagcttctgagcagttggggctacaggtacatgacactgtgtacagctttactaagctgatcatcattccagggataaattaggttgtaagtcagggttgcctgtggtactatatttgaagattatgcacttaaaaagaaagaggcatatgctttagattcatttccttgtcgctattggccttatgcttatatcacttatggaagatggatagggaaatcttgaatcgtggacaaattgtgggaaagtttccaaatcaagaaatataggctggttgcggtggctgatgcctgtaatctcagcattttgggaggctgaggtaggtggtttgtttgagcccaggagttccagaccagcctgggcaacatagcaaaaccctgtctctgctaaaaatacaaaaaaattggccaggcatggtggtgcatgcctgtagtccagctactcaggaggctgaggtgggaggattgcttcagcctgggaggtggattctgcagtgagctgtgatcacgccactgcactccagcctgggccacagagtaagaccctgtctcaaaaaaataattaattttttaaaaaagaaatataaattctcttttagtaagcttaaggctatga

SEQ ID NO: 336091 - DNA, 416 bp, Homo sapiens
tgagcccagatttcaccacagcactccagcctaggtgacagagtgagactacatttcaataaaacaaaaggaaaagaaccacgtatctagaaggcttccaccaggatgccacggcctttgggtgggtggaatcatgggtgttctttaggagctactttttgcttggctgtatttcttttttttccttcctattctgagcattggttacttttgaataagagacaggagctggacttactctaaactctactttaaatctctagttcattttagccagctttctctaattggcagtgtttttgaggaaacttcagattgaaaaagggtgaatgcttccaataaccagttaatgaggaagctgaggcccaagaggtccagtgatttatctgcccaggatgggcagcagggcaggctga

SEQ ID NO: 336092 - DNA, 557 bp, Homo sapiens
cattttctgcttaaactccttagagcggcttctgttgtctgcaactaacaacattaatcaaaacaacttcttaccttataccttaggttttttaatccttaatgtagtatctcctcctcattgttacagaacgtgcttgagatacatgcctcaaatttcacttgagaaaaggcaagtctcagttactttgaatatgtattatatcagctttatagactagcattagcactagtctcctccattaattcacttaacaaagatctattacaggggtactgtgtaccaggtgctgagatgaccatggtacacatataagacacagttcctgccttcatagagcttatcatctagtagaaaaagaatagcggctgggtgtggtggttcacgcctgtaatcccagcactttgggaggccaaggcagatggatcacgaggtcaggagttcgaaaccagcctgaccaacaaggtgaaaacccgtctctactaaaaatacaaaaatcagctgggcgcagtggcgcaggcctgtaatctcaactactcaggaggctgaggcaggag

SEQ ID NO: 336093 - DNA, 203 bp, Homo sapiens
aacttggggccacagatctctcagagatctgtccagtggtgagttgactggggcccagacaagcagcttgtccatcatctcagagtctctcgaaggccaggcctagaactcatctggctgccttactacctggtgtctggaatgggccccctaggcacacagatgtaccatttattcatccagtccatcacccaacacacatt

SEQ ID NO: 336094 - DNA, 260 bp, Homo sapiens
gtgtgtgtgtgtgtgtgtgtgtgtgtgtgtgtgctgctataacagaataccacagactaggaaatgttaaagaacagaaacttatttctcatagttctggacactgggaagtccaagattaaggtgccagcatatttagtctctggttccaagatggtgcatcattgctgcattctccagcaagggggaacactgtgtcctcacatggcagaagagtagaagagagagcgagagagagaaagcccacttccacaagccct

SEQ ID NO: 336095 - DNA, 338 bp, Homo sapiens
aatgaaaactaagtgtgtaattctaaataaatgttgactatataaaacaatagtgtcttcttggattgaatgtataattgataagatatatgcaaatagcaataaagaggctggagataaaggtaacaggaataaatttagtcaaactgtgttttgggcttttctatgtctgtgagaagaatttgaacatcataatcaaggaccctgtaattctacacccagatatatatacacagaggaattgtagcaaatgatatgtgaaagaatgttcattgtagcattattcataaaagctcaaaaaataagctgtccaaatatatatcaaataaggatggata

SEQ ID NO: 336096 - DNA, 515 bp, Homo sapiens
tgaagtgtcccatgtcttgcatctatttcattggcaagaaggattatctaaatgacattgaagacggggtgtcagtatttagatgatgaaggtttccatgagttcttgttttggggaacagaatgaatccatacatgagttcctgttttggggaacagaatgaatccatacagttacagagatatagagtgcctagagacagtagcccaattttttggttgcaggtttcctatgctatttacatgtttcagaaaacctagtgaatgtttagatgctatgcatgttgtccagcagctgtactcaggaaaagcaagagcaacatttgtgagtttcattacatcttattttattatttccataaaattgtgttttattatgcaatcacaaggacttctaagccaccaagagactgacaaggatttcgctttgcagaacaacccctaaaacagaacaaattcaattatccagaggcctattttgtaggagaggtaatctttgctttagaatttttaaaa

SEQ ID NO: 336097 - DNA, 397 bp, Homo sapiens
tgatttctcaggatgctcatttcctttcacaagtagtcccaggtagtatgtcatgtccagagcagtcctggtactctcctagaacaccacagctcaacatcctttcggttcactgtccagaggcctagcatgctcatttcctctctaaaccccttgactctcagaaatgtccctaacacatttacagtttacaaagtattttcacatgtcatttaattcttgcaagtactctgtgagatgacagagactcaatcattcatttattcagcaagcactaatcaagggctaggtaccatgccagaccctggggagacagaacaagctaagatgtgctgcccacacttgaggagctcacagaacaccaagggaaacaggcaatgccccggcctagctgcca

SEQ ID NO: 336098 - DNA, 140 bp, Homo sapiens
gaatatcatcattctcatctgactgaacgaagtcacagagaataacttgcccaaaattacataattagtaagtagcaaggagaggatctgaacccaggcagtctgattgccaagtccatgggcttagatactttgctata

SEQ ID NO: 336099 - DNA, 962 bp, Homo sapiens
cttctcagttgagagaatttgtgcctttgaactccatggcatattcatcctctaacagcgacatagaggacgacagctccaaatccaattccaacctgagcctctctgtgggctatttcccctgtgaggacaccccctgtgaggacacaacctcctgggaagatgcaccttccaagggtccttccatccactttctgcctcccgtccaaggggcatgggggactgaaaggatagggagacgcatgaagagacaagaccaaattcaggatgaaccagagcagttttgcaaactaagcatcttcctggcctgggacgtggacattggctccgataacacagactcaagagctaataggcttctaaatggagacaacctgtggatagacaagttaccaaaagagagaacaaaactgtctgttggcaaactgaataatcttgtgcaagagtttcagatatttctagaaaatctgaaagatgatgacgctgtatttcctgaaactgctcagcaagatttccagctatccagcggctcccctccggaaatggttcagatgataagccaggcaaccgccagccaaaggacaagcgctccagagatctcctcaatcctgtcagagcagccagagaaggatgacactccttcacacacacaggcccagtgctgcctgaactttgggtgggccttcagctggctgaggcagcgtatcctcccctctctgctgaggagggatcaccctgtgaatgccaccaaaagtccccatcggtcagcaccaacgaaaagactctttcacaagacaagagaattcaacatccagaagaccatgaattaggacaacacatataagacagatttttaaactttttggaaagtttaaaataatccataataaggattccattaataatccccatcagtttgttttttcctcaataaacaaaataaatgctcttgttaccccaca

SEQ ID NO: 336100 - DNA, 223 bp, Homo sapiens
aatgtgctttctcatttgtgggtggctcaactttttgataaagtgagatagaagtctctttgttgggagaagttgaagcaactgctgctgctatctaaaatacaaatagtggctcagaaccttccttcttcttcgccttccattggctgcagtggccccagcaccaccatggctggcctccagtcctaattcactgagatgtccagaaagaataatggtagag

SEQ ID NO: 336101 - DNA, 705 bp, Homo sapiens
gcatggtgtctctatttgctgttgaacagctgatataaaaggaattgaagcaggccatgtatggtggctcacgcctgtaatcccaacactttgggaggccaaggcgggaggatcacttgaggccagaagcttgagaccagcctgggcaaatagtgagaccccatctctacagaaaattttaaaattttttgttgtggtggcacaggcctgtggtgttaactgtttaaaaggttgagggtggaggattgcctgggccaaggacttccaggttgtgatgacctatgatcgcaccactgcactccgccctgggcaacagagtaagaccctgtctcgaaaaaaaaaaacaaaaaaacccaactcctaagattacaaaaagcagtaaatatctattacagaacagaagaaaataaaaatcacctttaatccagcacccaccaataagctctgggatcactggggggttatttccagcccttccccttcttttctttaagtttttgaaaattctaaaatattctaaagtagaacagaaaagcatagaaaataatattgcagacacccacctctcaggttgaacaaaccttaacattgccatacctgcctctcttctcttttctttctatctttcttagaaatagaaatgattcaggtccagaaggagtcaggacagtgtggtctactggccaaacccagcccctcatctgt

SEQ ID NO: 336102 - DNA, 1080 bp, Homo sapiens
gaataggacaggattggagaagtttggtgaaaatgggggtgcaagagaagcttggatttcccattaactgtcaatacagtcatggttccacctggtatctagaaacctgttcacaattgtaggtttagcagcacacagggtggggtaagtgtctctccccatcaggagcagcctctgaactctcctgggaccctgagcttcagggaacccaggctgtggcccccctcccccactttggcaatgctgtctgcagagggaagggccggttttactagcacagggagtgctccggctcctgtgtgtcggggaaattctggaagaggctctcttccagaagttatggaaggtccccgggagacagaccaccagtttgggccaaacccctccatctacatgaaacaacaacaacaacaataataatgtttacggccaggcaccatggtttatgcctgtaatcccaacactttgggaggccaaggcgggaggatcacttgaggccagaagcttgagaccagcctgggcaaatagtgagaccccatctctacagaaaattttaaaattttttgttgtggtggcacaggcctgtggtgttaactgtttaaaaggttgagggtggaggattgcctgggccaaggacttccaggttgtgatgacctatgatcgcaccactgcactccgccctgggcaacagagtaagaccctgtctcgaaaaaaaaaaacaaaaaaacccaactcctaagattacaaaaagcagtaaatatctattacagaacagaagaaaataaaaatcacctttaatccagcacccaccaataagctctgggatcactggggggttatttccagcccttccccttcttttctttaagtttttgaaaattctaaaatattctaaagtagaacagaaaagcatagaaaataatattgcagacacccacctctcaggttgaacaaaccttaacattgccatacctgcctctcttctcttttctttctatctttcttagaaatagaaatgattcaggtccagaaggagtcaggacagtgtggtctactggccaaacccagcccctcatctgt

SEQ ID NO: 336103 - DNA, 241 bp, Homo sapiens
gtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaa

SEQ ID NO: 336104 - DNA, 322 bp, Homo sapiens
atggtgcccagccacattgacgctgggtctgcctcttccagtccgctgactcaaatgttaaccttctttggcaacaccctcacaaacacacccaggaacaatactttgcattcttcaatcaagttgacactccataataaccacatacatgggggtatttaccaggtgtcttgttttggggtccccaggcgccgagtgtgcttgggtgagagtggaactctccctcgttacgcgcagcagctctggcggccacatggctgatgagtgcccacctggctttgaaggctgtccttgggcactgtgggcacagactcggagacgg

SEQ ID NO: 336105 - DNA, 555 bp, Homo sapiens
tcttaatgtccattcttggtagcctgtggaccccagagaaaggcaaatgtctaagtccatatccatcttcttgggacattccgttctctgacgcctgtctgagggactatctgtacccccaataaacttgcaaaaaccgaggcccagagaggtgaagccaccatctctaggtcacacagccagtaaatgcagagccaggtccaagcccagctgtgtgtgactccaatgccatgcctttaaccacctgacattactactctattattgctcagtccaggtggagacaacaggcattcaccaagcacttgctgtgtgtcaagggggcagtgggactggaggtgagggtggctgaggtactgatcctggaccacaggtgctgtcctgggaaggcagaccctcatactgctaagcatatgtcaggtaatgcatcatatatccacagtcattcattcattcagtctctgctcttgcctgtccctgggctctgggtggtgggtcagatatggtccttcccctgagagctcctgacccagcaggggaacagatagttaaata

SEQ ID NO: 336106 - DNA, 268 bp, Homo sapiens
ggaggaaagaaagagaaaactccaaaaacaaaaaaagaaaaaccaggcaattagaagaagcacaattggtcacagccgtaggaaaaacatcccatgtcagtagtcagtgaagaaaaagcaacagaaaccacagggcggcagcatgtctctcttttcagagctgcccgagttacaaaccaggtcctggagctggtgatgcggaggtgagtagacagagagctggggcaaaccgagaactccacctcccctcggcctcaagcacctcggg

SEQ ID NO: 336107 - DNA, 246 bp, Homo sapiens
tcagaggcagctccatggatccccactgttcacctgtgtatggaaactcaggttttctggtcacacttagataataaaaagtggaagaggcctttctatcaccaaacgctctaaatcagatcctggaaatgccagcttcattcagccgtgagcagtgctgctgaccgtggagctgtttcccccaccagactcagtgtgggtgtctgagtgtgtggtgtgagtgtgtgtaatgtgagcctgtggtgt

SEQ ID NO: 336108 - DNA, 166 bp, Homo sapiens
tctctaccaagcagccatcctggtgagaagggtgaggacggggctccccagggtccagggtccccgtggtgtccgtccacatgtgcgattttaaaggaaaatgggggaagctgatgctgtttacacctggagatgctcacgagcaagtagtgtcacagcagaacct

SEQ ID NO: 336109 - DNA, 336 bp, Homo sapiens
accctacagtaaaggtgatattcagggggtatggtgggaacagagaggaaggaatgcacccttggcttggagaatgggccccgtgagccttctcagcaggaatgtggaagacagtttgcatactgccgagggcacgctggtcaaagacacagtatgtgctaaaactcagagaagggaaagacagggtttgtctcatacgatcggagaatatggggaaatagccagagatgctttcattccacacatatctatggagtgtcaactaatgccaggtactggcaacagaaatagaagacacattcctcccttcaaggagtttagagactggtagggaga

SEQ ID NO: 336110 - DNA, 340 bp, Homo sapiens
ttgtacatcgaaacttaacatgagaggattgtgattagttagtggaaatcctattccttagtcaagcaaattttctcccaagccattttcctctatttattcacattattggcaaagctcactgtcatcataactctgaatctaatttctgctagtgagattaacaatgaccaagtaagtatactgttaagtgtgtttggatttatagcccatcccttgatttttcattaaggccactatcctgaattttgtcagtaaaaatattatgtcctcactgaatctctccctcacctaattctgtatttgtttataccactgcttatacgccattattgcattt

SEQ ID NO: 336111 - DNA, 399 bp, Homo sapiens
ccatggttcttggcagaggagggttgggggtgactgaggagagccaggcctaggcaatacaagcttctctgagcttcttagaatgcagacatttaaacagaaaacacagagccttcctggagagccttcctgaagaatcactgtgtcaagacctgaccatgggcaaacccaggaaagtttgcagccagatccccattcctgttacccaacgggaggggcaagactcctaggactggctagaaaattgctttgttgagtgtttgctgtggttgttcctaaacctgtctgtccagaagctggacatgcagtaggcccctgcgagtagaaactttccttgtgtggaagttttcgctggcaaaccagtctggcggcagcaggggggtgggtggggttctctgt

SEQ ID NO: 336112 - DNA, 196 bp, Homo sapiens
tgccaatccagtgcttgttacatgattatctgacaccaaggctctgtaacaaacatcctcaaaaagagaggcagtctctgcactgcctttcattcaccaaaacaaagatggagccctctacctagctgaactaaggttttggagtcagagtaaaattcaaaagaaaaagtcacagaataatgaaagggtgattata

SEQ ID NO: 336113 - DNA, 427 bp, Homo sapiens
catggtccaaacatccagctctctgatggtctgggtttactgagatgtaaaacttttggcaaaactgatatttttaagccattctttgtaaatattatttctgctaactgggtttttgatagactctgggaaataagcaattaaaggttgttttggggttctcttgtaagagacccaaaggaggcattctgagtaagtgatcttggggagactcacatacttaaaaatcaatggagtgtggggaaaggtggcaggactggtgatattttgcaaacattgagggtccctatactgagtgctttttggatttgcttttctaattcaaccagtcagccatagaaaattctcaattgcactcccaattatattatgatttagaataattagctccttttgaataccctagaatgaattctttaattgcaaa

SEQ ID NO: 336114 - DNA, 298 bp, Homo sapiens
cctccagctaagacacaatgcgacactgaaaaatcactggcaaagttcacagttgaactctgaaagtgatacttgtttttaatttttttgatccggccttgtgatatgattcctgttgtcaggttagaatcaattgtggtctctagtagcaaacacacctgtgacattctgttaaacaatcagctattctttctacttaaattttaacataagtgacattaagaaactgttttctttttttaactttcataatgcttccctaacttgtgtgccctactcttccgtaaattctctccac

SEQ ID NO: 336115 - DNA, 421 bp, Homo sapiens
ccagcagtaggagggagagactcactaaggacaaaaccccatgaaatgaccaagatgtacatggtttctttagaggagtatgggcaaaaaagaatgagaaataaaggctaaagatttatgaaaagaatctggacagaattacatctggggcatcaagagaagagaggattttcaagaaagctgccctggtaaagagggacacagtcttctgctgagatacatgggatggtcacaggattgacatcagggaatctctaattaagaagctgtagggtaggcttccttctccagcgctgtttttgtagagtaaaacagctgaaagtgataatttgaagagtgaactggaggtgaggaagtagagaaaagaggtataaactacccttgtaagaaatgaggtgctaatacattgaaaaggtacagc

SEQ ID NO: 336116 - DNA, 1385 bp, Homo sapiens
taactaatattagcaacaataatgactaatggcctgaagactgaagacatgaggaaatgttagaaataattgaaaacaacttgaagaaggaggataaagtgaaggtcctttgctgccagcatgatgtcgtatttataatatgtggaggagagagagctcaccatgctcagtttgagaagttgcagtatatctgtacacacaccctctattctacattgaggctcacaagtatttccctccggagtgtagctcctgtgaaatgctccaagatgatctcggatgcaaattcagccatgcaagagtgatgaaatgcttgcattatttccaaagatgaattaagacaatgaggcagctcttcatttgtcaagatccagcacaaaggtgctcaagaaatgttgatatgaaaaaaaatcaaaccaacctggctaagggttctctacactggaaattacctgtggataagttatgctgtagccagggtgctggtaccatccaaacagataattcagaggagacaggggacaccaaaataataagaaggacttgcaatcaaaacctgaagaggttttctctgacattgacttcagcagttcttcaccctaggaggtctacagaggggcttcaggaaaccagaaaccacatgcacaaagaagtatttttctgagaattgagcttatcagtttctgggttgttgttttttttccagattttcaaaggattctgtgaggcccccaaaacttgagaacctcttggattcatctctccactctggtttctacccccagaatctatcaagtggcctcactcctggattacctccagcacaagagaaagtgcatattctgtctgctctactgggccaggggagtagggaaagaacaggagacagtaaggataaaatgaaagcaacataaatgggcagcataaaatagaaaaagcagctattgcatctccctcatttcagattatttgtcagatatgcccttccccacacatgtgtgtatgcatgttccattacatcacagttctgtccatctgcccgtcccactagaccatgaatccttggcaatcaagaccataactctcatagtacccaacacaataactgccctgtaatacattcccaataagtatttgctgaatttaattgaagcaaattaatagaagacgacatattgtgcatagttcctataattatatacaaactgaggcccagaactgaaccattagccatggtattggtatcactgtcaactcagactcccaggcaacagtgcaaatggaattggaacacagggaccctctcctcacctccgcccctttgtttctcaaatgtacaaattctaaataaaatagaacaaaataaattttgtttggctttagag

SEQ ID NO: 336117 - DNA, 1157 bp, Homo sapiens
taactaatattagcaacaataatgactaatggcctgaagactgaagacatgaggaaatgttagaaataattgaaaacaacttgaagaaggaggataaagtgaaggtcctttgctgccagcatgatgtcgtatttataatatgtggaggagagagagctcaccatgctcagtatttccctccggagtgtagctcctgtgaaatgctccaagatgatctcggatgcaaattcagccatgcaagagtgatgaaatgcttgcattatttccaaagatgaattaagacaatgaggcagctcttcatttgtcaagatccagcacaaaggtgctcaagaaatgttgatatgaaaaaaaatcaaaccaacctggctaagggttctctacactggaaattacctgtggataagttatgctgtagccagggtgctggtaccatccaaacagataattcagaggagacaggggacaccaaaataataagattttcaaaggattctgtgaggcccccaaaacttgagaacctcttggattcatctctccactctggtttctacccccagaatctatcaagtggcctcactcctggattacctccagcacaagagaaagtgcatattctgtctgctctactgggccaggggagtagggaaagaacaggagacagtaaggataaaatgaaagcaacataaatgggcagcataaaatagaaaaagcagctattgcatctccctcatttcagattatttgtcagatatgcccttccccacacatgtgtgtatgcatgttccattacatcacagttctgtccatctgcccgtcccactagaccatgaatccttggcaatcaagaccataactctcatagtacccaacacaataactgccctgtaatacattcccaataagtatttgctgaatttaattgaagcaaattaatagaagacgacatattgtgcatagttcctataattatatacaaactgaggcccagaactgaaccattagccatggtattggtatcactgtcaactcagactcccaggcaacagtgcaaatggaattggaacacagggaccctctcctcacctccgcccctttgtttctcaaatgtacaaattctaaataaaatagaacaaaataaattttgtttggctttagag

SEQ ID NO: 336118 - DNA, 987 bp, Homo sapiens
taactaatattagcaacaataatgactaatggcctgaagactgaagacatgaggaaatgttagaaataattgaaaacaacttgaagaaggaggataaagtgaaggtcctttgctgccagcatgatgtcgtatttataatatgtggaggagagagagctcaccatgctcagtatttccctccggagtgtagctcctgtgaaatgctccaagatgatctcggatgcaaattcagccatgcaagagtgatgaaatgcttgcattatttccaaagatgaattaagacaatgaggcagctcttcatttgtcaaattttcaaaggattctgtgaggcccccaaaacttgagaacctcttggattcatctctccactctggtttctacccccagaatctatcaagtggcctcactcctggattacctccagcacaagagaaagtgcatattctgtctgctctactgggccaggggagtagggaaagaacaggagacagtaaggataaaatgaaagcaacataaatgggcagcataaaatagaaaaagcagctattgcatctccctcatttcagattatttgtcagatatgcccttccccacacatgtgtgtatgcatgttccattacatcacagttctgtccatctgcccgtcccactagaccatgaatccttggcaatcaagaccataactctcatagtacccaacacaataactgccctgtaatacattcccaataagtatttgctgaatttaattgaagcaaattaatagaagacgacatattgtgcatagttcctataattatatacaaactgaggcccagaactgaaccattagccatggtattggtatcactgtcaactcagactcccaggcaacagtgcaaatggaattggaacacagggaccctctcctcacctccgcccctttgtttctcaaatgtacaaattctaaataaaatagaacaaaataaattttgtttggctttagag

SEQ ID NO: 336119 - DNA, 98 bp, Homo sapiens
catcacgacattatactttttaatagcaaaagactgaaaacaacacaaacatccatgaaaaggggacatattaagtaaactatggtacatacatatta

SEQ ID NO: 336120 - DNA, 1063 bp, Homo sapiens
aatcccaggtagatgttgtcagataaacttgaggtaaggccaagaagacagacattttatgcttcatactttctgtaattatcttttgtagcttgattacatagagtaccctctcttccttaagttgtagttgctatttatcattgtagacaaattctgttgcctttcagcaacgtatgctgaactagtatcataagatggtgcatcagttcataagctagtgcataagttttgtgtcaaaacttttaaatcctgaagttctgcagttatcatcttagttattttctatctaattagcttataattgcaaacactagtcagcttgtgatctctgtgtttcaagttcttttcttcacgaggttcagtacctgctatgttgatctttggcagtgccagaggcttaaattttgacctgctcaattaaaaataaacactggcgtttataatgaaaaggtttttttgtcgggggggggggggtcaagagaatttattttgtgatagtaataattttcaagaccttcagtcattcctatgtctatgttgctatctttattttaaaacttagaaccctgatctaactcccttctcaagtgaagatactgtgtagattcaagaattataatgtagagtaataggcctttaagtttttttttaatctgttagaaataaagagcatgatttaattattgttgaattaacaattaaaatgaatccctttggagggatggcattgaataacttataatttcagtgaatcatttacgttttcattggaagacagtatctgatttcaactggtgcgttacgaagtagagccattcccacaaagtaaatgtgcagtgcccatgtttcttgtgtttaaatattttttattttcactacatatatattattttctcatgtttatttactaatgtaattttcacttaaaattagatgtttattttcaaattttaaaagctagtgctcttaaaagagctaaattatatttctggaagcaggagtttagtataaatgtaataaaattttaaaataaaattgacttccctacttaaaattgggt

SEQ ID NO: 336121 - DNA, 3045 bp, Homo sapiens
acgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaa

SEQ ID NO: 336122 - DNA, 3126 bp, Homo sapiens
acgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaa

SEQ ID NO: 336123 - DNA, 817 bp, Homo sapiens
gaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaa

SEQ ID NO: 336124 - DNA, 4347 bp, Homo sapiens
acgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaa

SEQ ID NO: 336125 - DNA, 4478 bp, Homo sapiens
acgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgag

SEQ ID NO: 336126 - DNA, 4092 bp, Homo sapiens
acgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttccgtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaa

SEQ ID NO: 336127 - DNA, 4367 bp, Homo sapiens
acgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtttgtgcctttctttcgcagtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaa

SEQ ID NO: 336128 - DNA, 3077 bp, Homo sapiens
gttaacgaataattggggcttttagctcccagttctagtgactgccttttcataaagacagtatctgcagcttgctttcccttacccctgtagctccctctcgtacaaacttccctctcctttcagagcagaacaggatctatcagaatcccatttgccatcttcctccttttaggttgcctaagattgctaaattaaagaacttcagtaattcagattgacctgtaattttaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaa

SEQ ID NO: 336129 - DNA, 3271 bp, Homo sapiens
agcagaattaacacaatagcccatttcaacaagctgtatatttgagaacagagtgacagttattaacatccagtaggaaattaagagttgttgttcacaaataataaattactagattctgacaaagactaatggggattaagtaagcgtgactcaatataacaaatttaagcctaagcatcttctaggccctgaaatgaacaaggtattgctgccagttaaagtcagttgtgtcttacaacctgctagctgtcttgctgtaaaaactgtaacgtaaggcccttgaaatagatgccgtcatcagccccagcccccaagcattcatctatttaaacacatgacagaagatggtggaagagagttcagcagctattcatgtggtagaagtggttattgtattaggacatactctgttgtaggccagcaacttttgagttaaaacaccgcagctgtttctcttcctttctttacatctttctcttcttttttttttttcttagcaataaactcacttttttttccccacaaacattttgtgtagatccaaggagcaacaaattccaactttctgctgtagcaattacacgctttttgtctgtttgactagattttagtattttactttttttcttctttttaaaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaa

SEQ ID NO: 336130 - DNA, 4382 bp, Homo sapiens
acgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagc

SEQ ID NO: 336131 - DNA, 4382 bp, Homo sapiens
  misc_feature (3800)..(3800): n is a, c, g, or t
  misc_feature (3807)..(3807): n is a, c, g, or t
  misc_feature (3827)..(3829): n is a, c, g, or t
  misc_feature (3835)..(3835): n is a, c, g, or t
  misc_feature (3840)..(3840): n is a, c, g, or t
  misc_feature (3849)..(3849): n is a, c, g, or t
  misc_feature (3852)..(3853): n is a, c, g, or t
  misc_feature (3858)..(3858): n is a, c, g, or t
  misc_feature (3876)..(3876): n is a, c, g, or t
  misc_feature (3882)..(3883): n is a, c, g, or t
  misc_feature (3888)..(3889): n is a, c, g, or t
  misc_feature (3894)..(3894): n is a, c, g, or t
  misc_feature (3896)..(3896): n is a, c, g, or t
  misc_feature (3911)..(3911): n is a, c, g, or t
  misc_feature (3915)..(3916): n is a, c, g, or t
  misc_feature (3918)..(3919): n is a, c, g, or t
  misc_feature (3925)..(3925): n is a, c, g, or t
  misc_feature (3928)..(3929): n is a, c, g, or t
  misc_feature (3931)..(3932): n is a, c, g, or t
  misc_feature (3935)..(3936): n is a, c, g, or t
  misc_feature (3941)..(3941): n is a, c, g, or t
  misc_feature (3949)..(3949): n is a, c, g, or t
  misc_feature (3951)..(3951): n is a, c, g, or t
  misc_feature (3954)..(3954): n is a, c, g, or t
  misc_feature (3956)..(3956): n is a, c, g, or t
  misc_feature (3958)..(3959): n is a, c, g, or t
  misc_feature (3966)..(3966): n is a, c, g, or t
  misc_feature (3969)..(3969): n is a, c, g, or t
  misc_feature (3971)..(3971): n is a, c, g, or t
  misc_feature (3986)..(3987): n is a, c, g, or t
  misc_feature (3994)..(3994): n is a, c, g, or t
  misc_feature (3997)..(3997): n is a, c, g, or t
  misc_feature (4004)..(4004): n is a, c, g, or t
  misc_feature (4009)..(4009): n is a, c, g, or t
  misc_feature (4012)..(4012): n is a, c, g, or t
  misc_feature (4016)..(4016): n is a, c, g, or t
  misc_feature (4019)..(4019): n is a, c, g, or t
  misc_feature (4023)..(4023): n is a, c, g, or t
  misc_feature (4026)..(4026): n is a, c, g, or t
  misc_feature (4029)..(4029): n is a, c, g, or t
  misc_feature (4033)..(4033): n is a, c, g, or t
  misc_feature (4043)..(4043): n is a, c, g, or t
  misc_feature (4046)..(4046): n is a, c, g, or t
  misc_feature (4049)..(4049): n is a, c, g, or t
  misc_feature (4059)..(4059): n is a, c, g, or t
  misc_feature (4064)..(4064): n is a, c, g, or t
  misc_feature (4068)..(4068): n is a, c, g, or t
  misc_feature (4088)..(4088): n is a, c, g, or t
  misc_feature (4116)..(4116): n is a, c, g, or t
  misc_feature (4139)..(4139): n is a, c, g, or t
  misc_feature (4143)..(4143): n is a, c, g, or t
acgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccacncccgtcncccccccgcccccgcccaannnaccccnacccnacccccgcncannccccnaccccccccccccccccncccccnnccccnnacccncncccccacccaacccngagnnanncacccncgnncnnccnnaaccncccccccnanccnancnncaaccanccnanaacacccaccccacnncaacacnacncacaaanacccnccncaanccncccncanacncccnaccacccccnccnaancaccccagancaccnaacnccccccccccccaagccccntccatgcccccaatcccagcccccgcanccagagaccacaggccccccccncganaccctggcccccccccataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagc

SEQ ID NO: 336132 - DNA, 3133 bp, Homo sapiens
acgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaa

SEQ ID NO: 336133 - DNA, 2031 bp, Homo sapiens
gaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaa

SEQ ID NO: 336134 - DNA, 1977 bp, Homo sapiens
gaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaa

SEQ ID NO: 336135 - DNA, 1749 bp, Homo sapiens
acgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgagtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtaagacaacattcaaattt

SEQ ID NO: 336136 - DNA, 1226 bp, Homo sapiens
tagaatcgagcgtcggcctgacagtaaaatgaacacattgccatattatactgctgcccacgcaatgagttggtgtttacagtgttcccaaggagtggcttatcttcacagcatgcaacccaaagcgctaattcacagggacctgaaaccaccaaagtaagttataataatgtgacacccctcagcctcttcctccttctctctcactctcaccaccccgaacccactctctaattcaagctactcgggaggctgagccaggagaatcgcttgaacccaggaggtggagtttacagtgagccaagatcgcaccactgcactccagcctggcgacaaagtgagagtccgtctcaaaaaacaaaaagaaaaaagaaagtaaaaaattaaaagcaggactgatggagcatatgtatatgtagaaaaatacccagtcatgtgttctgatagtgcttgcattcacattgtgtcttttgttatatgcaataaagttctttttagtttgtgcctttctttcgcagtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggttcgtaaaaagaaatttttcttaaaagtactttttgtgttttctacttggaagactactcctgtccccttccctaaagaatatcatttatctctaacattaaaatgtacaattctttgttaagagactgctttgctattatcagactctgccctgtccctgccccagagtccagcagagcaggattgagagtagtcctggtctacacatgcggctgaggatgttcactggctccgctgattagggaaaggccatcagtacgcaacctagacagttggctctctcttagggagaagcatcaggctggatcatgga

SEQ ID NO: 336137 - DNA, 4095 bp, Homo sapiens
tagaatcgagcgtcggcctgacagtaaaatgaacacattgccatattatactgctgcccacgcaatgagttggtgtttacagtgttcccaaggagtggcttatcttcacagcatgcaacccaaagcgctaattcacagggacctgaaaccaccaaagtaagttataataatgtgacacccctcagcctcttcctccttctctctcactctcaccaccccgaacccactctctaattcaagctactcgggaggctgagccaggagaatcgcttgaacccaggaggtggagtttacagtgagccaagatcgcaccactgcactccagcctggcgacaaagtgagagtccgtctcaaaaaacaaaaagaaaaaagaaagtaaaaaattaaaagcaggactgatggagcatatgtatatgtagaaaaatacccagtcatgtgttctgatagtgcttgcattcacattgtgtcttttgttatatgcaataaagttctttttagtttgtgcctttctttcgcagtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaa

SEQ ID NO: 336138 - DNA, 4150 bp, Homo sapiens
acgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaa

SEQ ID NO: 336139 - DNA, 4231 bp, Homo sapiens
acgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaa

SEQ ID NO: 336140 - DNA, 3637 bp, Homo sapiens
tggttaattaatttttgcttattatttctctgaactattaggcttttatagtgaccaagtaaattagtcatttcacagaagttgaatgataacattcattttgcttaaccttttccatttccacaaatgtctcttcttttattgtagaataaaatgttggccttgtaacttttgatgttttttgtttttttttaaacagcttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaa

SEQ ID NO: 336141 - DNA, 4583 bp, Homo sapiens
acgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 336142 - DNA, 2970 bp, Homo sapiens
acgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtga

SEQ ID NO: 336143 - DNA, 2230 bp, Homo sapiens
acgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggtatcatagaccacctgagttggtctaatagctgtggaaccggaataatgatccctggtacttgtaaaatgcttcttgctccaatttttacaagacatgaaaatggataccttgcatgcagtaattagggagacagattgaaaaactacatttattctgaagcagtcttgaaaagatacctctgatctacaataagtgaggataaaatagaagagaaagtaaacctttttggagaagggagaacaccaacccagaattctaccaacttcctctctacttttaagtgagcacatgagctaaacccagaccttttttgcacccaacagaaagaggaaacaactaattaaaatttgttattttccttggctcctttccttcctcagttactgctttttgggtcccctctagactttctgtcctaacctctttctgttggtagcaagtgaatgtgaagttgagagaagagagttgctaaatagcattttgccttaacctggaaaacaaaaagtaaa

SEQ ID NO: 336144 - DNA, 526 bp, Homo sapiens
aaaaacatcaagaaaaacaagcctgtgaaacacgatggaagaagaaatacaaaatctgaatagacctgtaagtaaagtgattgaattaatacatttaaaactttacacaaagaaaagcctttacttgtgaatctatcaaacatttaaagaatcaatactattcctgaaaaaatagaagatgagggaaaacattccaacttattttatgaggtcaaatatcaccctaatagcaaaagcagaaaaaagtcagtgtaaaaaggaaaactgcagaatgacatctgttataaatcttaggacaaaaatcgttaacaaaatgctagcaaactaaatccaacaacatgtaagaaggattacacaccatgtccaagtgtgacttacaaataaaaatcaattaatataccatattaatagcataaaagacaaaaactataaaagaattagctgaaaagatgtagaaaaagcattcaggaaaatgcaccactttcatgataaaatcactcaataaactatgaaaagatgaagtatg

SEQ ID NO: 336145 - DNA, 490 bp, Homo sapiens
tacaactggagacttgcagggaaaaaaaaagttttcaacagactaggccccaaacatgaaggataaaagtaaatgtgaaaaaggaattcaattttcaaatatatgcataagtatatgagaatacttcaaggataaataaaataaaacaaattatctttaatgactattacccagggataatttttaagacttttggaacaactacatccccggattttatggaaatatcagctctcaataaataagttttcttaatgcctatctgcttagacaacctgcacaatctttgcttgctctaatgaagagcaggtataactgagatggcttgcctttaccctgtggttatcaagttcttataccagaggtatcaaagtgacatcctgcaaattctaacaagcccccaaacagttgttccacacatcattttaaaaatcagaaaaataacataaagttttagatttctaatctttcttaaaaaataggaagatcg

SEQ ID NO: 336146 - DNA, 572 bp, Homo sapiens
gacacttaaggttggtcttgttgaatctagaatttagtccttggaattcacagtccagcaactcaaatcctaaaaggtcatccaaggataatcaggaaattgggaactcatcctggtaacatcctgctagtcaacctctgtggagcctgacttggaaggcagggtgctgacatggtttcagaacatggagattcacttggtccatatccaatgctagggcacggacggcctccatatgtcaggttaacagacaacatttagacctcaatattatttggtaagtaaataactagaacacaggaagtttaagtttgtttgcaggattttttttttcttttttgagacctgcaggtctcactctgtcacacaggctggagtgcagttgcgtgaccaccactcaccacagcctcaacctcccaggctcaggtgatcctcccacctcagccttcctagtaactgggactacaggcaagtgtcacaacacgcggctaatttttgtattttttgtagaaacaggtttggccacattgcccaggctggtctcaaactcctggcctcaagcaattgcccac

SEQ ID NO: 336147 - DNA, 294 bp, Homo sapiens
ctgtggttggggaccagaaagactagagtgctggtagatggaggaatactggaggtaggcagaaggtctagactgggaggggtctggggatcacctgctggcctccttatcacggccttcttctccaggtggccatcaaagtgattccccggaatcgtgtgctgggctggtcccccttggtgagtaccttcggagcccttcctaacctacctactccatcactgatgtattcacctccttgcttttccaggggatgtatgactccctgggccctgtaacagtgagaatactgcc

SEQ ID NO: 336148 - DNA, 1594 bp, Homo sapiens
ctgaaaagtaacaggatccccttaccagagaaagaatactcaggatggtaacaggatcccctcaccagaataggagcccaggatctctttgactatatcacagagaagggcccactgggtgaaggcccaagccgctgcttctttggccaagtagtggcagccatccagcactgccattcccgtggagttgtccatcgtgacatcaaggatgagaacatcctgatagacctacgccgtggctgtgccaaactcattgattttggttctggtgccctgcttcatgatgaaccctacactgactttgatgggacaagggtgtacagccccccagagtggatctctcgacaccagtaccatgcactcccggccactgtctggtcactgggcatcctcctctatgacatggtgtgtggggacattccctttgagagggaccaggagattctggaagctgagctccacttcccagcccatgtctccccagactgctgtgccctaatccgccggtgcctggcccccaaaccttcttcccgaccctcactggaagagatcctgctggacccctggatgcaaacaccagccgaggatgtacccctcaacccctccaaaggaggccctgcccctttggcctggtccttgctaccctaagcctggcctggcctggcctggcccccaatggtcagaagagccatcccatggccatgtcacagggatagatggacatttgttgacttggttttacaggtcattaccagtcattaaagtccagtattactaaggtaagggattgaggatcaggggttagaagacataaaccaagtctgcccagttcccttcccaatcctacaaaggagccttcctcccagaacctgtggtccctgattctggagggggaacttcttgcttctcattttgctaaggaagtttattttggtgaagttgttcccattctgagccccgggactcttattctgatgatgtgtcaccccacattggcacctcctactaccaccacacaaacttagttcatatgctcttacttgggcaagggtgctttccttccaataccccagtagcttttattttagtaaagggaccctttcccctagcctagggtcccatattgggtcaagctgcttacctgcctcagcccaggattctttattctgggggaggtaatgccctgttgttaccccaaggcttctttttttttttttttttttttgggtgaggggaccctactctgttatcccaagtgctcttattctggtgagaagaaccttacttccataatttgggaaggaatggaagatggacaccaccggacaccaccagacactaggatgggatggatggttttttgggggatgggctaggggaaataaggcttgctgtttgttctcctggggcgctccctccaacttttgcagattcttgcaacctcctcctgagccgggattgtccaattactaaaatgtaaataatcacgtattgtggggaggggagttccaagtgtgccctcctctcttctcctgcctggattatttaaaaagccatgtgtggaaacccactatttaataaaagtaatagaatc

SEQ ID NO: 336149 - DNA, 589 bp, Homo sapiens
tagcattggggctggcgcgcgcggcgaatctcaacgctgcgccgtctgcgggcgcttccgggccaccagtttctctgctttccaccctggcgccccccagccctggctccccagctgcgctgccccgggcgtccacgccctgcgggcttagcgggttcagtgggctcaatctgcgcagcgccacctccatgttgaccaagcctctacaggggcctcccgcgccccccgggacccccacgccgccgccaggaggcaaggatcgggaagcgttcgaggccgagtatcgactcggccccctcctgggtaaggggggctttggcaccgtcttcgcaggacaccgcctcacagatcgactccaggtatccgtcatgagggtcttgggagggtcaggtgcgtgtggcgggggcgggggtcctggccctggaatgctggttgaccgaggagtgagcctgcagagtgtgtagaggaccaggtgtgtgtgtgtgtgtgtccgtgtccgtgtccgaggagtgagcctgcagtgtgtgtagagggccaggtgtgtgtgcgtgcgcgtgtgtgtgtcggtctaggaggttatgggcggggg

SEQ ID NO: 336150 - DNA, 416 bp, Homo sapiens
gactatatcacagagaagggcccactgggtgaaggcccaagccgctgcttctttggccaagtagtggcagccatccagcactgccattcccgtggagttgtccatcgtgacatcaaggatgagaacatcctgatagacctacgccgtggctgtgccaaactcattgattttggttctggtgccctgcttcatgatgaaccctacactgactttgatggtaaggcttctctaaatctccctggagggattgtttttacttgatggccttgtgacctttggcctccagtggtggggtgtcctgtaatccttgacccatactgcattatataagatgatcgattgctaatactggggattctcagccttgccctctgataaagtccatcttttaatggtgtgctaaccttattctgggc

SEQ ID NO: 336151 - DNA, 741 bp, Homo sapiens
ctgagcctcccaagtagctgggactacaggtgcatgccaccaagcctggctaatttttgtgtttgtgccattttgcccaggctgatcttgaactcttgggctcaagcaatccacccacatcagcctcccaaagtgctgggattgcagggatgagccactgtgcctggccgaacttctttcgtttattcaaatgtttattgatctacgacatgcgagatttgtgcaggctctttgctggtttcaccctctcaatcgctgtgtgagtttgtgtctttagggaaagtgaggcccaggaagggaagtgagttgcttagcgacacactgtcaggaaaaggggccctgagttgagcttaggtaaaaagcctcagagctgttgccctgacatctgtcttttttctctccctgcttcccaccccacctgtgcccccagtcagactcagtcacatgcccactcgaagtcgcactgctatggaaagtgggtgcaggtggtgggcaccctggcgtgatccgcctgcttgactggtttgagacacaggagggcttcatgctggtcctcgagcggcctttgcccgcccaggatctctttgactatatcacagagaagggcccactgggtgaaggcccaagccgctgcttctttggccaagtagtggcagccatccagcactgccattcccgtggagttgtccatcgtgacatcaaggatgagaacatcctgatagacctacgccgtggctgtgc

SEQ ID NO: 336152 - DNA, 2070 bp, Homo sapiens
tagcattggggctggcgcgcgcggcgaatctcaacgctgcgccgtctgcgggcgcttccgggccaccagtttctctgctttccaccctggcgccccccagccctggctccccagctgcgctgccccgggcgtccacgccctgcgggcttagcgggttcagtgggctcaatctgcgcagcgccacctccatgttgaccaagcctctacaggggcctcccgcgccccccgggacccccacgccgccgccaggaggcaaggatcgggaagcgttcgaggccgagtatcgactcggccccctcctgggtaaggggggctttggcaccgtcttcgcaggacaccgcctcacagatcgactccaggtggccatcaaagtgattccccggaatcgtgtgctgggctggtcccccttgtcagactcagtcacatgcccactcgaagtcgcactgctatggaaagtgggtgcaggtggtgggcaccctggcgtgatccgcctgcttgactggtttgagacacaggagggcttcatgctggtcctcgagcggcctttgcccgcccaggatctctttgactatatcacagagaagggcccactgggtgaaggcccaagccgctgcttctttggccaagtagtggcagccatccagcactgccattcccgtggagttgtccatcgtgacatcaaggatgagaacatcctgatagacctacgccgtggctgtgccaaactcattgattttggttctggtgccctgcttcatgatgaaccctacactgactttgatgggacaagggtgtacagccccccagagtggatctctcgacaccagtaccatgcactcccggccactgtctggtcactgggcatcctcctctatgacatggtgtgtggggacattccctttgagagggaccaggagattctggaagctgagctccacttcccagcccatgtctccccagactgctgtgccctaatccgccggtgcctggcccccaaaccttcttcccgaccctcactggaagagatcctgctggacccctggatgcaaacaccagccgaggatgtacccctcaacccctccaaaggaggccctgcccctttggcctggtccttgctaccctaagcctggcctggcctggcctggcccccaatggtcagaagagccatcccatggccatgtcacagggatagatggacatttgttgacttggttttacaggtcattaccagtcattaaagtccagtattactaaggtaagggattgaggatcaggggttagaagacataaaccaagtctgcccagttcccttcccaatcctacaaaggagccttcctcccagaacctgtggtccctgattctggagggggaacttcttgcttctcattttgctaaggaagtttattttggtgaagttgttcccattctgagccccgggactcttattctgatgatgtgtcaccccacattggcacctcctactaccaccacacaaacttagttcatatgctcttacttgggcaagggtgctttccttccaataccccagtagcttttattttagtaaagggaccctttcccctagcctagggtcccatattgggtcaagctgcttacctgcctcagcccaggattctttattctgggggaggtaatgccctgttgttaccccaaggcttctttttttttttttttttttttgggtgaggggaccctactctgttatcccaagtgctcttattctggtgagaagaaccttacttccataatttgggaaggaatggaagatggacaccaccggacaccaccagacactaggatgggatggatggttttttgggggatgggctaggggaaataaggcttgctgtttgttctcctggggcgctccctccaacttttgcagattcttgcaacctcctcctgagccgggattgtccaattactaaaatgtaaataatcacgtattgtggggaggggagttccaagtgtgccctcctctcttctcctgcctggattatttaaaaagccatgtgtggaaacccactatttaataaaagtaatagaatc

SEQ ID NO: 336153 - DNA, 2015 bp, Homo sapiens
tagcattggggctggcgcgcgcggcgaatctcaacgctgcgccgtctgcgggcgcttccgggccaccagtttctctgctttccaccctggcgccccccagccctggctccccagctgcgctgccccgggcgtccacgccctgcgggcttagcgggttcagtgggctcaatctgcgcagcgccacctccatgttgaccaagcctctacaggggcctcccgcgccccccgggacccccacgccgccgccaggaggcaaggatcgggaagcgttcgaggccgagtatcgactcggccccctcctgggtaaggggggctttggcaccgtcttcgcaggacaccgcctcacagatcgactccaggtggccatcaaagtgattccccggaatcgtgtgctgggctggtcccccttgtcagactcagtcacatgcccactcgaagtcgcactgctatggaaagtgggtgcaggtggtgggcaccctggcgtgatccgcctgcttgactggtttgagacacaggagggcttcatgctggtcctcgagcggcctttgcccgcccaggatctctttgactatatcacagagaagggcccactgggtgaaggcccaagccgctgcttctttggccaagtagtggcagccatccagcactgccattcccgtggagttgtccatcgtgacatcaaggatgagaacatcctgatagacctacgccgtggctgtgccaaactcattgattttggttctggtgccctgcttcatgatgaaccctacactgactttgatgggacaagggtgtacagccccccagagtggatctctcgacaccagtaccatgcactcccggccactgtctggtcactgggcatcctcctctatgacatggtgtgtggggacattccctttgagagggaccaggagattctggaagctgagctccacttcccagcccatgtctccccagactgctgtgccctaatccgccggtgcctggcccccaaaccttcttcccgaccctcactggaagagatcctgctggacccctggatgcaaacaccagccgaggatgtacccctcaacccctccaaaggaggccctgcccctttggcctggtccttgctaccctaagcctggcctggcctggcctggcccccaatggtcagaagaaggtcattaccagtcattaaagtccagtattactaaggtaagggattgaggatcaggggttagaagacataaaccaagtctgcccagttcccttcccaatcctacaaaggagccttcctcccagaacctgtggtccctgattctggagggggaacttcttgcttctcattttgctaaggaagtttattttggtgaagttgttcccattctgagccccgggactcttattctgatgatgtgtcaccccacattggcacctcctactaccaccacacaaacttagttcatatgctcttacttgggcaagggtgctttccttccaataccccagtagcttttattttagtaaagggaccctttcccctagcctagggtcccatattgggtcaagctgcttacctgcctcagcccaggattctttattctgggggaggtaatgccctgttgttaccccaaggcttctttttttttttttttttttttgggtgaggggaccctactctgttatcccaagtgctcttattctggtgagaagaaccttacttccataatttgggaaggaatggaagatggacaccaccggacaccaccagacactaggatgggatggatggttttttgggggatgggctaggggaaataaggcttgctgtttgttctcctggggcgctccctccaacttttgcagattcttgcaacctcctcctgagccgggattgtccaattactaaaatgtaaataatcacgtattgtggggaggggagttccaagtgtgccctcctctcttctcctgcctggattatttaaaaagccatgtgtggaaacccactatttaataaaagtaatagaatc

SEQ ID NO: 336154 - DNA, 542 bp, Homo sapiens
aatcttccctctctgcttcttggcctacagactgctgtgccctaatccgccggtgcctggcccccaaaccttcttcccgaccctcactggaagagatcctgctggacccctggatgcaaacaccagccgaggatgtacccctcaacccctccaaaggaggccctgcccctttggcctggtccttgctaccctaagcctggcctggcctggcctggcccccaatggtcagaagagccatcccatggccatgtcacagggatagatggacatttgttgacttggttttacaggtcattaccagtcattaaagtccagtattactaaggtaagggattgaggatcaggggttagaagacataaaccaagtctgcccagttcccttcccaatcctacaaaggagccttcctcccagaacctgtggtccctgattctggagggggaacttcttgcttctcattttgctaaggaagtttattttggtgaagttgttcccattctgagccccgggactcttattctgatgatgtgtcaccccacattgg

SEQ ID NO: 336155 - DNA, 581 bp, Homo sapiens
cgcgcggcgaatctcaacgctgcgccgtctgcgggcgcttccgggccaccagtttctctgctttccaccctggcgccccccagccctggctccccagctgcgctgccccgggcgtccacgccctgcgggcttagcgggttcagtgggctcaatctgcgcagcgccacctccatgttgaccaagcctctacaggggcctcccgcgccccccgggacccccacgccgccgccaggtgagtacatcctcccctactgcaaccagacggggtgggctggaatgatgggttgcagcgcggggggagggagtcgtggctgggctcagcacgccgccaccctgacttcctcgcctccgcctgcgtaggaggcaaggatcgggaagcgttcgaggccgagtatcgactcggccccctcctgggtaaggggggctttggcaccgtcttcgcaggacaccgcctcacagatcgactccaggtatccgtcatgagggtcttgggagggtcaggtgcgtgtggcgggggcgggggtcctggccctggaatgctggttgaccgaggagtgagcctgcagagtgtgtagaggacc

SEQ ID NO: 336156 - DNA, 131 bp, Homo sapiens
atgggggtccccaggcagtgggcaatgtgataatttacactagttccagtttagaggtttagagcagtggttgataacctgtatttcttgaattccttgttggagaaacagttgtttgaaagagattccat

SEQ ID NO: 336157 - DNA, 250 bp, Homo sapiens
gcgtggtggctcacgcctataatcccagcactttgggaggccgaggtgggcagatcactattgggggaaccggcccccaatatttcaatgtaggttcttttctattttccctaagtgttggctggtctgagaaataaagggaaagagtacaaaagagagaaattttaaagctgggtgtccgggggagacatcacatgttggcaggttctgtgatgccccctgagccgtaaaaccagcaagtttttattag

SEQ ID NO: 336158 - DNA, 347 bp, Homo sapiens
tctgtatgtgggggcaacagagcagtgagtgtgtgcttgtgggggtcccccatggcttctgttagggtgcatggcctataagagttccccagagtcccctctaggtcgccagccctttgcagtgggtggggtccagaagggacctcgagattggccttcgcttccccatgggatggatgggcttcagggagatttgtcctgtgaaactccaggtcccagaggcccctgagggagttcaggctacctgggatgtgagctcaggcgagttttcctcccgaggcccctgcgcctgctgcctcacggtacctgcctccccttcccaaggcctccagtccctactgggctct

SEQ ID NO: 336159 - DNA, 436 bp, Homo sapiens
cagagagagccatgcctgcctgtagcaggtgatgaataaattatgacggtcgtgatttgttaggcaaggctgctcttccgacccctgtctcagagcatgctgggaaaaggtgctgctaagatttgcaagaggataaacaacagcccagatttggagcacatcaagaacaaggaattgatgctagagcagggctggctggaaggggcggcagcatttgacctccttcctggaggtctcactcctgagttccttaggcgccaagagggctctggtctgccccttttcactcgtacctcacgcttctcagctgcctgctgaggaaggaatgattttccacccacccccatctttttctcaaggccagggtccacctggaaaaattctgagacctgaggagttggggcagctgtccttttagccacccacctctaaacag

SEQ ID NO: 336160 - DNA, 203 bp, Homo sapiens
ccagatgcacattcttatttaaagttcacaacatccctatgagtgagggatcactattcccattatacaaacatataaattaaggtttggagggctatattacttgccctgaagtagtgctgaccagtgacagagccagaatttgaactcaggcctgcctgactccagagtcttggtaataactatgttgtataccaattgac

SEQ ID NO: 336161 - DNA, 172 bp, Homo sapiens
atataaataacttataagatggaactcactgactttaaaactgcttttcccatagctgacttttcttacttaacagtgatagaccttattctctgacttcctgattctaactaacaccctccaccccctcttcaagtgtagatctggttttgtatttaaggtcaatgatgag

SEQ ID NO: 336162 - DNA, 143 bp, Homo sapiens
tgtcagaaggaagaacaagctcattttgaaaagtacacagacgttggaaactgtgagtattacccaaaaaaaagcttgaaaggctcccatccccatcgggtgaccagcagaacttgccactgcaagagcctcgttctcattaa

SEQ ID NO: 336163 - DNA, 472 bp, Homo sapiens
agttttcacatcaagaccatctgaaaagtaggtttcaggtaacaatccatgtctccaaaaacaaatgtggacaatttttatccatgttcctaagggagaaagtggaaagcttttggaagtcaaaattcataaatgagttccatttatcactctaagatgtgggcaaaaataaacagtgcttctgcacacccccacagagggaacaggctacgctgagcttccacttaactagggtgattcacaaaatcagagcagggcttccaaccagtcagacggcggctctgagcccagcacaaccacctccgtgcctcagggacagagaactggatgtgggcattgccagcccacccttggcacccctgggctcacgccaatgcatcacttcacaatactgggaaggactgtgggacaaagatgatcctatctacccagataaggtaggagtcaaatgacccctgcgggtgacctgagc

SEQ ID NO: 336164 - DNA, 110 bp, Homo sapiens
actgtaacccaaacatattatagagaaaaacctttttgcaaaactctaagaactcagtttaagcctcaccacctccaaatgaatacatagttcaccttggacaacacagg

SEQ ID NO: 336165 - DNA, 262 bp, Homo sapiens
gcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagt

SEQ ID NO: 336166 - DNA, 439 bp, Homo sapiens
gtcccatccacggagctttgtccacaggcatctgggccacctctctcattagagaacggggccagtcctgctgtcctggctgacttcggctccattaatccacccctttgccttccattctccttgcaggctgcctgtgctgaaggcctcttgcactcctgtgctatcccaacttgcagtaattgcttggggttgtaaatccagcaagtagaggaggctttctgtagcaggtcctaggtcggttgcctgaggacagcactgctctccccagcccctagcactgagaggccctgtgggaagtccacgcctgccatggtggttgtcctgccaacagcatctcccttcagggttcatcttattttcttctgatgaacaagcaaaggcaaccagactctccgtaggtgtaagttggcacgcacatttggcagggagggtggat

SEQ ID NO: 336167 - DNA, 423 bp, Homo sapiens
ggaatgactaaatcacaaaacagtcaccgaattgcaactgtgataatgccaagggggaggagggactgtgtaggccgatgctgaaggctgggtgaaggttttccaggggcaagtcccatcagtcacagtgcccgtttagggtttgcaccttgctcttttgacgacgctgctcggctctcagggctgcgaggctggcttcttcccaaacttcattccactccaggtttctgcactgggccctgagagccacatctggccatcactacagatgcacttttgcagtgcctctgcattttgaggtgaaagacagtctttaaacttcagggtgaacttctcactcggagtttggtgtattgttgccatttcttttgtgttgatttgcacgtagctcttttgtacacaggcacgagggtaagcattcct

SEQ ID NO: 336168 - DNA, 282 bp, Homo sapiens
gatctgggcaggattggggaagggctattaaaaagcaagagctttggggtcaggcagacatggactcatatgcaatttttgctgtttatcagtcctgggaccttttgcaaatcatttaactgttctgagcctctgctaatggggttgttggttgtatgaattaaatatagaaacatggaatatacttagtgctgtgcctcatatttaggaagcatgtatctaatgagctgcaatagatgctcattatcatcacggtgggtttcggggtcagcgattcagttt

SEQ ID NO: 336169 - DNA, 299 bp, Homo sapiens
tccagcctgggtgacagagcaagactctgtctcaaaaataaaaataaaataaaatatacctactaagcatctacccgtgccaagcactattctaggcacaggatatagtgaaaaatgagatagacaaactgagaaaaaagaaataggatcattcattcttcactccccaatattatagaactagttcaggcctattaatgaaataactgagggctacgaaaatgtagcgtgcatagactaacgcaggcacgtgacgagcatttactgaaacacacactttggcgttccaccaccaggct

SEQ ID NO: 336170 - DNA, 757 bp, Homo sapiens
atcccatttttgctttatatttttctatcttctatacttctccaatacttgtcttagcttgtttttcattttctatctgaaactcttgacaatattttcattttctatcttgtttctatcttccaattttcttctaagtttgtacattttgcccttagctttttgtttcctagcttgtcttttttcttctgcttcctacttttcaggtttaaatttatcttttttcttctaaaagtatgtttttatcttctaatttccctatcttctctattcttttcttcgccttcccgtacttctgtcttccagttttccacttcaaacttctatcttctccaaattgtttcatcctaccaccaaacaccgcaatctgattcaaactaatgagggagggaggtaaaggtgaaataagattagtcatatgttgttaattgttatggtcatatgttggcaattgttaaagtgggcaacataaggatttatgatacgtttttctctctagtatatggtttgatattttccataataaaaagctaaaaagaaaagtgtccaagtttgtaacaaatgtgaaaaagatctccagtaaaagtggctaacataaaattttacatgatacttgaaggattaagttttactgacctagagcagggttggcgaactatttaggccaagtataggcagcaagctagactaataaagaagaaaagagagaagatccaaataaacacaattagaaatgacaggccaggtgcggtgtttg

SEQ ID NO: 336171 - DNA, 815 bp, Homo sapiens
atcccatttttgctttatatttttctatcttctatacttctccaatacttgtcttagcttgtttttcattttctatctgaaactcttgacaatattttcattttctatcttgtttctatcttccaattttcttctaagtttgtacattttgcccttagctttttgtttcctagcttgtcttttttcttctgcttcctacttttcaggtttaaatttatcttttttcttctaaaagtatgtttttatcttctaatttccctatcttctctattcttttcttcgccttcccgtacttctgtcttccagttttccacttcaaacttctatcttctccaaattgtttcatcctaccaccaaacaccgcaatctgattcaaactaatgagggagggaggtaaaggtgaaataagattagtcatatgttgttaattgttatggtcatatgttggcaattgttaaagtgggcaacataaggatttatgatacgtttttctctctagtatatggtttgatattttccataataaaaagctaaaaagaaaagtgtccaagtttgtaacaaatgtgaaaaagatctccagtaaaagtggctaacataaaattttacatgatacttgaaggattaagttttactgacctagagcagggttggcgaactatttaggccaagtataggcagcaagctaaataatttctacttttagtcattgttaaaaagaaaagaaaaaagaatatgcaacagaggacctacatagcccacgtgcctaaatatttactatctggcccttctgccaacccctgatgtagagaatcagg

SEQ ID NO: 336172 - DNA, 335 bp, Homo sapiens
cagtcactgcctctttcacactcaaaacattccagaagaatgtgccaaggccctgtgcacttccatgtaaggcagtgtttacaggcaccggcacctcctgatgtgtgagccagacacaggagcagcagagcttcagccgcctcctcagggtcgagggaagtcccattccagctcaggtttcctgtgagcccctagtgcgggtagtgtgtatgtgtgtgtgtgtatatatgtgtgtatgcgtgtgtgtgtttaagctcaacttcaaaatatccccttgatcagtagtgaccagacctccattgacagcacatctgctgtctacctgacaccagcag

SEQ ID NO: 336173 - DNA, 466 bp, Homo sapiens
ccagaatgaagcagccacttaaaaagtgacgattaagtgaaaaatccctatggttgtgtgctttcaaactcaaccaggtctttattggtttgatttgttgctggttagatcctgaccctggggaccatttcagacactcctcaccctgccacagcataaagcccaggctttgtctctctcatcctcagcagatgatctcaatgtctacttttttaacaaagtataattgctatttcatttttttccagaggatagttttccatccttaagattgaaaacaccttatacgggctttcgcggaggtcatggaacagcaccattaggtctaaatcagggaggggtattggatccttctgggcttcatgagaatgactcctgactacttttccatgaatggcacaactcatatcacaatgcagtttctcatacagctgggaagcacaggtgttaaagacactcacttcag

SEQ ID NO: 336174 - DNA, 230 bp, Homo sapiens
ctcacttacatagtgaagaatagatcagaaaggaagcttacagtaatgaaggttacagatgacagaggtctacattaggacaacaggagtaaataaaaaaaatgagatgcatttaagttgtttactgggtatatcttacaggactagtgactcaatgtggacagccagaaagggagaaagtcagtcaaggagtcaagtgatttctggcttacaaccaagttgagactggg

SEQ ID NO: 336175 - DNA, 288 bp, Homo sapiens
gggtacttctcagaaagggaaaatggatacccaatggcccaaacccaaaatagccccagttcccctaactttgactacagggcagtccagtttgggtgccgcttccgttgcactcacatgtcctacatatctgttgactactcacaagtgcaaatgcttattctcaactcaacattaacattttttctggcaacccaggttcactggttctcttccacagagcggccctgagcagctgagcctgcaagccacgcaagcatctgtttcttcttttgccaagtacaggag

SEQ ID NO: 336176 - DNA, 92 bp, Homo sapiens
agcaggctcacaagattgcattctttgaacagtaggctctagatgtctcagtagataacctcaaagagcatggcgccagggagtgattgccc

SEQ ID NO: 336177 - DNA, 359 bp, Homo sapiens
atgtgtatatgggtgtgtatttgtgtgcgtgtgtgtctgcatgtgtattttgtgtgtatgtttgaatgggtgtgtatttgtgtgtgtgtgtgtctgtgtggtcctcagaaccccccacatttcctggcagtggacagcacgaacgctccttgacccccacgggcaggggaagcctgctgagcctcttttctctccgaggcatccgacttctgccaacggtgagttagaaggaaggggcctcagccaacagcaaaagctacagaaggattttccgcgcctgacctggactgtggtgcgcacacagccctctttgtcttctctttctctggcccctcacacaggtgctgtttgtagaggac

SEQ ID NO: 336178 - DNA, 719 bp, Homo sapiens
gagtcaaacagatctgactactacatctgtgctaggtactttcagtggttgaatcttaatgattctgactctgtttgctcacatgtaaaatgtggatgatcatagaacctttatcacagatttgtgaagactgcattgcacactccatgaaaagttatccttagcacagcatcaggcacagggaagctcaacgccttgaaggtgctgtttttatttctaggtccctaagatcttcctcgtcctccttatggctcccccctttattctccatatttgttccttccttgaaagtcaagggtgcaggaagaagatgatatcctggaggccaagcccacacaattaggacatgtggtggacattcacctgttcttagatccactgctgctcttcctctgcttgtctatcacaaggggctgacacctgcacactaattctgtcttgagggagactgtgtaggggaacatggccatttgagttcattaggaaagggttttgaggtcaggacatgggtatctggtgtacatgggagtttggtggcctctattgtaggaggctttggaaatgtgtattgttgggaggtcctgagggaggaagtttgggatgaacatggagattctaggctgtggaggaagatgtaacatggctattggaggattctgggaccttaccttggtaccttggtaccttggtaatgaggacatcttcagctttatttttat

SEQ ID NO: 336179 - DNA, 691 bp, Homo sapiens
gttaagttgctggttcatatcacaagaatatctgaatggaaatggggtacctgagcagctggactcatcaagctggaaatccatgcagtcggcaaaaccatcacagcgctggtgggctgggatacagctgttggaggaggcacacaccagagctccattagaacagcttttgttggctgcaaaaaaaaaagaataatgatcagggatgccagcatgatttttttttgtcccaatgaattctcacaacaaaataacataaaacagtttattatattactcttgattttttctagtctgatattttagaacacagttctttttgaagaatatttcaaatggattaacttaaaaatgtctgaaagaaaaaccacatttgcctgaaaaatcacttcgcagatgtgcattcttagggactgaattgtgtcctcacctcaacattcatatcttgaaaccctaacccgcaacaggactgtatttacagataggagctttaagaaggtaacaaaggttataagaagagagagacatcagggatgcaatgacatacaggaaaggctacgtgaagacacagcaagaaggcagccatctgtaagccaaggagagaggccttaggagacaccaaacctgcctacacgttgatcttggacttttagcctccagaagtgggagaaaataaattcctgttgtttta

SEQ ID NO: 336180 - DNA, 848 bp, Homo sapiens
  misc_feature (848)..(848): n is a, c, g, or t
gttaagttgctggttcatatcacaagaatatctgaatggaaatggggtacctgagcagctggactcatcaagctggaaatccatgcagtcggcaaaaccatcacagcgctggtgggctgggatacagctgttggaggaggcacacaccagagctccattagaacagcttttgttggctgcaaaaaaaaaagaataatgatcagggatgccagcatgatttttttttgtcccaatgaattctcacaacaaaataacataaaacagtttattatattactcttgattttttctagtctgatattttagaacacagttctttttgaagaatatttcaaatggattaacttaaaaatgtctgaaagaaaaaccacatttgcctgaaaaatcacttcgcagatgtgcattcttagggactgaattgtgtcctcacctcaacattcatatcttgaaaccctaacccgcaacaggactgtatttacagataggagctttaagaaggtaacaaaggttataagaagagagagacatcagggatgcaatgacatacaggaaaggctacgtgaagacacagcaagaaggcagccatctgtaagccaaggagagaggccttaggagacaccaaacctgcctacacgttgatcttggacttttagcctccagaagtgggagaaaataaattcctgttgttttaagcaacaaccatggattaaaaataacaaattaaatggccctgttgggctcaggcgggggagccttgcgcgcatctcctttgaggagggtaaccatagatccccgctactaactgcgtacgatcaggcgcccgaatggcagaaacgccaccccccccn

SEQ ID NO: 336181 - DNA, 803 bp, Homo sapiens
  misc_feature (701)..(701): n is a, c, g, or t
  misc_feature (705)..(705): n is a, c, g, or t
  misc_feature (709)..(709): n is a, c, g, or t
  misc_feature (713)..(714): n is a, c, g, or t
  misc_feature (726)..(726): n is a, c, g, or t
  misc_feature (730)..(730): n is a, c, g, or t
  misc_feature (734)..(734): n is a, c, g, or t
  misc_feature (736)..(736): n is a, c, g, or t
  misc_feature (738)..(738): n is a, c, g, or t
  misc_feature (752)..(754): n is a, c, g, or t
  misc_feature (764)..(764): n is a, c, g, or t
  misc_feature (769)..(769): n is a, c, g, or t
  misc_feature (772)..(772): n is a, c, g, or t
gttaagttgctggttcatatcacaagaatatctgaatggaaatggggtacctgagcagctggactcatcaagctggaaatccatgcagtcggcaaaaccatcacagcgctggtgggctgggatacagctgttggaggaggcacacaccagagctccattagaacagcttttgttggctgcaaaaaaaaaagaataatgatcagggatgccagcatgatttttttttgtcccaatgaattctcacaacaaaataacataaaacagtttattatattactcttgattttttctagtctgatattttagaacacagttctttttgaagaatatttcaaatggattaacttaaaaatgtctgaaagaaaaaccacatttgcctgaaaaatcacttcgcagatgtgcattcttagggactgaattgtgtcctcacctcaacattcatatcttgaaaccctaacccgcaacaggactgtatttacagataggagctttaagaaggtaacaaaggttataagaagagagagacatcagggatgcaatgacatacaggaaaggctacgtgaagacacagcaagaaggcagccatctgtaagccaaggagagaggccttaggagacaccaaacctgcctacacgttgatcttggacttttagcctccagaagtgggagaaaataaattcctgttgttttaaaaaaaaaanaaantggnctcnntgccccaacggnggancttngngncgttccctttaggnnnggttaattangaccnccnctacttgattcctaccctcgaagtcacgggg

SEQ ID NO: 336182 - DNA, 604 bp, Homo sapiens
gttaagttgctggttcatatcacaagaatatctgaatggaaatggggtacctgagcagctggactcatcaagctggaaatccatgcagtcggcaaaaccatcacagcgctgctgttggaggaggcacacaccagagctccattagaacagcttttgttggctgcaaaaaaaaaagaataatgatcagggatgctgtcccaatgaattctcacaacaaaataacataaaacagtttattatattactcttgattttttctagtctgatattttagaacacatttcaaatggattaacttaaaaatgtctgaaagaaaaaccacatttgcctgaaaaatcacttcgcagatgtgcattcttagggactgaattcatatcttgaaaccctaacccgcaacaggactgtatttacagataggagctttaagaaggtaacaaaggttataagaagagagagacatcagaaaggctacgtgaagacacagcaagaaggcagccatctgtaagccaaggagagaggccttaggagacaccaaacctgcctacacgttgatcttggacttttagcctccagaagtgggagaaaataaattcctgttgtttta

SEQ ID NO: 336183 - DNA, 221 bp, Homo sapiens
caggctcattcggctccaggttgttgccaaattgctggcccatcctcatcttagagatgtcttttctcctaacccttttcttctgtccattccaggcatccctctacccgcctgcctctacccactaggaaagacttaaaattccttttactttattatgtagaaggatttaactctcaatcctcatctcaggccagactccaggccacctttattgacac

SEQ ID NO: 336184 - DNA, 758 bp, Homo sapiens
gggcagtacggatgtgcgagccaggaagaggaggacgtgaagatgtggggtccccgcttagcaggcagtaacagaggaggaaaagctacaatactgcctggtatatatacttgacaacacagcatctgagcctctggtgaccctggggaagacctgatggagctccctgtcaggaccaaatcctggagggaggggagggagctgactgagctcccactatgcgtcacgctcccactcaagcctcgccagcccccattaaggccttataggccccccttgcagatgacaaaagtgacaggcctgaggatcccaacagggcatctcagaacatgctagaggacgaagcagaaaacggcagagcttcggacacagcaggactcgagccgggccaggccctgacagctgtgtgcactgggccgtgttactcagcagagcctcagctcccactcccacatatgagctggtagtgggtttttttcaccagaaccggtaaaactgttctcagtttcgggaggtgtaagtaagtggttgcctcttagactcagatgcagttctggactctggctagagttctgaatttgggaccagggtctctagttcccacgctgacatctctccctagcctggaattgtctcttctgactgtggcctctcaaggacaccagtgaagaggaaggggagctgtagcctggctgttctaaaacctacccacgtcccttgggctgctcctatttagattgaactgctgtgctgcagcc

SEQ ID NO: 336185 - DNA, 403 bp, Homo sapiens
agaggggaaagacacgtgctcaaacaccaataacaattttaccagcccactcctgaagaagtcacagaaagcgcgatcatgcaaagagccaggagccagcagccagcagccaaaacccaagaagtccagactcaggtgggaggccctcagagagtacagttccgtaacagagactgaggcctggagaaagaagtccatgccaccagagtcaggactatagctcagggctcctgaatcatggcagatgtctgatagatcatttctggccctaacattctagaagttggatgtgagcagaccaggactagtgatcattgggaaggcaaagtaaaaactctaagtgagccatcaaaaaatctagggaccacaccagggccagctgctcaggaaacatttttgtctg

SEQ ID NO: 336186 - DNA, 304 bp, Homo sapiens
atcctctggaattgggactatatcttatgattatttgggaccagagttcctgacgtagctgaatgtacttcacctttgaaattaggtattgcaataaaggttggctaaagactgagaggggttccccagtcatgcttattacaggttcacaatgcccaacaacctaactcgtggttgaattactgaaggtcatgagatgttgggcaagattttgttttttaagtcgttaactcagtgttcattggttcagaattccaattgtgtctagatattggagatttaaaagaaaagccatttgctaaac

SEQ ID NO: 336187 - DNA, 437 bp, Homo sapiens
ggcacatttactgtcatattggaacggagagttgatgtcatattacaagctgagtaaacctagcagctccttctctgatatggttaatcaaaaaggaatcaagcccccaactgcagggcttctgaattaatgatgaattgaaggagaaaagaagcaacagcaacagcatatttgtaaagccaaggcttcaaagtaactcaggacagctcatttagataagtcatgaacctaaatggctaaattaaagcaagactgtgattaccaacacagctgggattaggcaagctgtggcacaagaattaagccacatgaaggggaagagccacaggtcagaaggtccccagaaaatgtctaacaagagaagcaagttaaccggaaatcagccatgtgccttaaccagaagtcagctgtgacttttaggcctcttctggaagtgg

SEQ ID NO: 336188 - DNA, 1851 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggtcagacccaactcaggccttggtgtccctggactgcaagtgtggaaggagggaaagcctggtttacctctctctgcatctgagctctgctacccatggagcagatggatggtgggaacaggaaagagcttatgttacacctcattcccatgcttagcccacccagagctaacccctgtcttcttccccaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacattt

SEQ ID NO: 336189 - DNA, 1037 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctct

SEQ ID NO: 336190 - DNA, 236 bp, Homo sapiens
accctggtgtgtccttcaagataacaaggcctgttggcttctgcctgccgccgatgtagattatgtatcttttcctgaggaccaggagcatggaaaaagttcctaggaaaggcctctgacttccctcacctcccaaccatcattacaggaaagactgtgaactcctgagttcagcttgatttctgactacatcccagcaagctctggcatctgtggattaaaatccctggatctct

SEQ ID NO: 336191 - DNA, 2081 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacatttaaaaaaaaaaacaaaacaaaaacaaaacaaacaaacacaaaaaaaaaaaaaaaaaaaaaataaaccaaacaacaaaaccaaaaaaaaaaacaaaaaataaaaaaaaaaaaaacagagagcggaaagagagaagaaaaatagacaaacaagaaagaaaaaaccaaaaagatggaggggagcgcgtagaccatacgacaggggaggaggagaagaaagagagaaccgaaagtaaaatgagaaagaggagacaagtaataaacagaacacaacataacaatggggcggcagcgaaaaaacgaagcacgcggatagagaaagtgaagttacgaggtcaatgaacaaaccatatatagggggacatacaaaggacgaacacaacaatgagagagccgaaagtagaaaagcgggaggttgacaactc

SEQ ID NO: 336192 - DNA, 2294 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacatttcttctgacttcctttattttcacaatcattcaattcatagcatttcctatattctgttataattatttcattgattcataaatttctttgaaaaataatttggtcttctattgattgtgagaagataatctaagtttaatttggtcagagaatatcatctgtttaataaactttgaaatttggtgagtgaattatcttttttactgataaagagtgatgtcatcttttttaatgtttcacataggtttggaaagaatgcattttagattgtgtgtagtattttctattagattatgtttgcaatttttgtttcaatttatatcttatatacttaattttttgttgtctgtcacctgagaggtgtgttcaaatctccaactatgatagtggatttgtgcatttgtctttatagttccattttcttacatactttgcagttactttattaaggtatatgtaaatttacatttatatttttcttctgaactgaactctttgtgtggtagcctgcttcatctataggctaatgtgtttaaccttgaaaactactagttttaatattaatataactgtcaattcttttggttaccctttgcttgacatcctttctcttgaatttccattcttttttagtttcaacctttctttatatttaccacttgtatacagcatttaaagggttatttat

SEQ ID NO: 336193 - DNA, 1327 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggaggcaatcctctcccaaccccaccattcatccttacactttcccaatctcccttttcccatctctccctactccaccacccctcctcctcactctaacccccatctctccccacccttcctcccctccccttccttacctcatcctctctctctctccaccatcactctc

SEQ ID NO: 336194 - DNA, 1649 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggtatgtacaagatgagagcgagcctttcagaagccagggtctggtcctggctcctcttactgagatacagggcagcattggcagagagcagacttaaggaaacctgtaaggaggacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacattt

SEQ ID NO: 336195 - DNA, 1519 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacattt

SEQ ID NO: 336196 - DNA, 1710 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggtcagacccaactcaggccttggtgtccctggactgcaagtgtggaaggagggaaagcctggtttacctctctctgcatctgagctctgctacccatggagcagatggatggtgggaacaggaaagagcttatgttacacctcattcccatgcttagcccacccagagctaacccctgtcttcttccccaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacattt

SEQ ID NO: 336197 - DNA, 1670 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggtatgtacaagatgagagcgagcctttcagaagccagggtctggtcctggctcctcttactgagatacagggcagcattggcagagagcagacttaaggaaacctgtaaggaggtaaggatgttccctgtctctgccctccctctgagcaggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacattt

SEQ ID NO: 336198 - DNA, 1660 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacattt

SEQ ID NO: 336199 - DNA, 2348 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacatttcttctgacttcctttattttcacaatcattcaattcatagcatttcctatattctgttataattatttcattgattcataaatttctttgaaaaataatttggtcttctattgattgtgagaagataatctaagtttaatttggtcagagaatatcatctgtttaataaactttgaaatttggtgagtgaattatcttttttactgataaagagtgatgtcatcttttttaatgtttcacataggtttggaaagaatgcattttagattgtgtgtagtattttctattagattatgtttgcaatttttgtttcaatttatatcttatatacttaattttttgttgtctgtcacctgagaggtgtgttcaaatctccaactatgatagtggatttgtgcatttgtctttatagttccattttcttacatactttgcagttactttattaaggtatatgtaaatttacatttatatttttcttctgaactgaactctttgtgtggtagcctgcttcatctataggctaatgtgtttaaccttgaaaactactagttttaatattaatataactgtcaattcttttggttaccctttgcttgacatcctttctcttgaatttccattcttttttagtttcaacctttctttatatttaccacttgtatacagcatttaaagggttatttat

SEQ ID NO: 336200 - DNA, 1975 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggtatgtacaagatgagagcgagcctttcagaagccagggtctggtcctggctcctcttactgagatacagggcagcattggcagagagcagacttaaggaaacctgtaaggaggtaaggatgttccctgtctctgccctccctctgagcaggactctcagaagaaagacaagctgctctgcagccagcttcaggtagcggatttcctgcagaacatcctggctcaggaggacactgctaagggtctcgaccccttggcttctgaagacacgagccgtgagtaggcaggggattgtagtagcagctgacctgagtggggaaggaaggaggatttcagttaggtctcccatttggctgatgggaaggaggcccagtgttgcagggaggcaggctagcaggccaccctcactcatgtactcattcctggtggctcatctcaggacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacattt

SEQ ID NO: 336201 - DNA, 1435 bp, Homo sapiens
taataccggtccctcacaagacctggcagaagcaggaagccagaagcaggagcagaagcaggaagcaggacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacattt

SEQ ID NO: 336202 - DNA, 1623 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcagcaggcagaacaggagcgggacaagctgcagagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacattt

SEQ ID NO: 336203 - DNA, 1412 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcttagcccacccagagctaacccctgtcttcttccccaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacattt

SEQ ID NO: 336204 - DNA, 324 bp, Homo sapiens
ctgggattgcaggtgtgcaccaccacgtcaggctaatttttgtatttttagtagagatggcatttcaccatgttggccaggctggtctcaaactcctgacctcaggagatccacctgccttggccttccaaagtgctgggattacaggcatgaaccactgcgcctggccccggatggtttctattacatgtcatatttccatctgaaaagccctcaagctggaaccagctgaccctcttcagacctggccctatgtctaggagctgagggataatttattacaatctgtcgctcctcagcccaggacactcattagaatcacaa

SEQ ID NO: 336205 - DNA, 699 bp, Homo sapiens
aggctctgtaaaataccaagtactagatatgtatgggtaactattttgattctcacaatcatcctgaggaagcagtgtagacaggtgatataaattgatcaatatcacacccaatatgtggcagactccagattcaaactgaagtctctctctgatgctaatgcttattccctctccatataccacaccaactcctgaacttctgtaccagcttggacgttatggaaaatgggagctttaaatgttcttgaaggccaggcacggtggctcacgcctataatcccagcactttgggaggccgaggcgggtggatcacaaggtcaggagttcgagaccatcctgggcaagatggtgaaatcccgtctctactaaaaatacaaaaaaattatccgggcgtggtggtgggtgcctgtaatcccagctacacaggaggctgaggcagagaattgcttgaacctgggaggcaaaggttgcagtgacctgagattgtgccactgcactccagcctgggcgacagagcgagactccatctcaaataaataaataaataaattaaattaaataaatgttcttgaacatggggaaacatattttcattgcagtttatttatccaactgagtatttattcacttatttatttgctttctctagtggcagtgtaggggacaacttaaatggaggggagatcagaggcaaaa

SEQ ID NO: 336206 - DNA, 195 bp, Homo sapiens
ccctcccctattctgagtggttggtgggctgtccgtcagtcttactgtcttataacctgagcttggtcatccctattgcaacagtgattgctgttactcatgcagagccagtcagaatcctttttttgaaatttatggttgaatgctaggacaaagatactaccttttctctgaaattgttaatctgggaaggtg

SEQ ID NO: 336207 - DNA, 216 bp, Homo sapiens
agacataaataaagcaagatcccaaatattcccacacacagctcctaaaataaatgggagaaacacagttgtgtataagaaagtaccacacagctacaacaaaggagcccatgggagagaagaagagatcatgacccaaaaagctaacagagacctggccatacccatcctatcctggccagagcagcattcttgtcccaggtagtttctgtgagg

SEQ ID NO: 336208 - DNA, 575 bp, Homo sapiens
gaggggcctagagcagctctttccctcgcagccctcaaaaggagtgatccctgccaacaccttgatctcagacttctagcgtcccagcccgtgagaaaatgaatttctggaggtgaagcttcccaggctgtagtactttattatggcaggcctagaaaacgaattcattcacagacccccagttaagaagaagcaggaggaggaggcaaaaaacaaattactcttttaagtgaattcatctcatgttaaaatataaaatatgtgagaatgtgtgcatttcattagatatggggagcttaattgaatcatcttttaaaagaaataatcggaatttagttctataataagagtaaaatcaagaaagcaggaaaagtctgaatttatattgatgtagtacccttgaagtagtatcatagaccggaaacagcagcttcattaaggccaaagtgtgtttgttaattagctgtggtcctctccagtgagccgaccaatagatgccatcaatgatgagagagcatggacttattgacgaaaagatgaagtcagttgggcattagacacacatgtttcctccg

SEQ ID NO: 336209 - DNA, 171 bp, Homo sapiens
gttgagttacttattttgtgtgaactacatatttgtccataggatataaatatcaggctagagcttttaacagccgagagaattttttcaattcccttcacatttggatagtacttaattaggaaaataataataatcttccatagcagaatcataagatagtaaaacccc

SEQ ID NO: 336210 - DNA, 138 bp, Homo sapiens
ccagggaggtcaatgactggtcaaggctctgacacctgaggcagaaccacatgggaggtaggcattccgcccccagcctagggccctccacatcccacgccgcttccttcagtgcagggtgatgctgccactgaccag

SEQ ID NO: 336211 - DNA, 219 bp, Homo sapiens
tcagaaatgtatcaaggtgtggaggacaaagctggacaggaagaagcaggaagacaagttatgaggctattgaggtagtctgtgcaagatatactaaggacctgatatgaggaagtgacagtgggctaggaaagggaataaatacttgaaagatatttctgaggtataatttttaaaattttaacaaattggttgtaaatagggaaatggtggaataag

SEQ ID NO: 336212 - DNA, 447 bp, Homo sapiens
cttctcttatctgactaaaagcagcaacttctgggaaacgaggctgccataaagtccctctccagggcagttttaagatcatgaagaagctggaaagacccaccatacctgcataaacaagtactaccacaaacgtatttcctatttattctcctaaaaaaacttgtctttcctaaagaaacctatttgttcttctcatagaagcctttctcccagcttcctttttcctactaaattagaaagccttggctgggtgcagtggctcacacctgtaatcccagcactttgggaagctgaggtgggcagatcacctgaggtcgggagttcaagaccggcctgaccaacatggagaaaccccatctctactaaaaatacaaaattagccaggcgtggtggcacatgcctgtaatcccagctacttgggaggctgaggcaggagaatcgctt

SEQ ID NO: 336213 - DNA, 610 bp, Homo sapiens
atacagacccaaaactaaattgttttactaatttcaaatttcatgccttgtttaatttgcaaactgaagtcagtccagtaagttatagataccactgaattgatatgtgttgtgatattcatgtatttattcatattacctatttatttgttcaacagatgtctgctgagcaactatattgaagaaggatgtctgccagaccttagtaacaatgtcattgcaaaacaagataaagatgaaaagaattggtataataaccaagaaagggcagtgatgattatcattctaactaaagacaaaccacacatattgaatttctgaccgctatagaaagaagagtattgaacattgagattagttcaatacacaaacaccccacatttgcagatggatatgcaatagagaacaaagcacattgcactgatgtctggaaagttttgcacacctagtgattcatttacagaccatgctggacaggagcatctccatacagaggtgacttcaggtgttcagtgcatggtttatggtcctcaaaaaaaattgcatggtgagaggacagagattcaggacatgggatttccagactcacttatctttagctctatgagtt

SEQ ID NO: 336214 - DNA, 553 bp, Homo sapiens
ctactcaggaagctgaggcaggagaattgcttggaggcagaggttgcagtgagccgagatcacgccattgcaatccagcctgggcaacaagagcgacactctgtctcaaaaaacaaacaaacaaaaaaaacggggctaataacattcacaggttgttgtgcaaaccaaagatcaagaacgtgaacgtgctgtttcaggggaaaaagctgacttgctccaagtgttcgctcgggtaactggaaggtatgacctctgtcacaggatgcggagctgggctactgctgccagcagaagagaaagtcactatccagcagaaggtcaagagggctctcccaccacagtctcttcaatacagaccaaaatacttgacctgctgagctcagcctccttggttttgcctggaggagcaaacagtgacctaccaattagccaagagcttctgtaaagtggggcaaaggaaaggaaaaagaacaaaaaacaggtgacatgtgtgtttgtgggctggaagaaacgaagcagaaccctcagcttcttgccacacatccaggcctct

SEQ ID NO: 336215 - DNA, 365 bp, Homo sapiens
gaggcagctctcctggaggcagctagcgtgaggctggggagcgcagagctgcgtgtcatgccctgcgctgcccagactagtgaacaatacagtcaggatggctaaaggtgaccccaagaaaccaaatggcaagatgtctgcctatgccttctttgtgcagacgtgcagagaagaacgtaagaagaaataccaagaggtccctgtcaattttgcagaattttccaagaagtgctccaggaggtggaagacaatgtccaggaaagaaaagtctaaatttgataaactggcaaaggtggataaagtacgctatgatcgggaaatgaaggattatggaccagctaaaggaggcaagaagaagaaggatt

SEQ ID NO: 336216 - DNA, 540 bp, Homo sapiens
atttgtgatggcagctctatacccacaaacatgcgcgtgtgcaccaaaagaatgggaataaattgcacaaatccagtgaaaatcccaaaggtgatttttttaaatcaatgtattcatgaaagaagatagagaaaaccaagcttttaaaaaatgaggaatgaaatagggatatgttacttggcatcatgggggtgtagtaacagaaccgtgatgagacggtttcgtcattggcgcacagagtgtgcttgcatttaaagtaattttacctttgaagactgcacctggaatcctttgtaaattttccacaatgagtatactttttgttgttgttgttgttttgagacagagtctcactctgtcgccctggctggagtgcagtggtgtgatctctgctcactgcagcctccgcttcccgggttcaagcgattctccggcctcagcctcccacatagctgggattacaggcgcacgccaccatgcccgactaatttttgtatttttagtagagacagggtttcaccatgttggccaggctgctct

SEQ ID NO: 336217 - DNA, 306 bp, Homo sapiens
ctccaaactcacacatacttcatctctcaaatgggctctaagactagatatgaggatggaaaagaacagctagcctttcacacacacatacctggaagcaggaatcatttcaccttcccaaacacatctgtccctgacctttctctttgtgctgctcttcattccacataccttccaaatgtcttccagcatttcagaccttgggaccaggtagagacagcacccccatttcagcgtcaggcccctctttcaatgcatagttcccctaacagaaatcttgtctccccacttgtcttactccagctt

SEQ ID NO: 336218 - DNA, 782 bp, Homo sapiens
gagaactactgcctttttaaggctgagtaatattccattgtaagcctattctgccttttgtttattcgtttgtttgtagatggcggagtgtgttacttccagcattgagctaatgtgaataatgttacttgaatatggatgtggaaatacctctttgagaccctgcttttagttcttttgggtatatatgcagaggtggaattgccagatcacagagtaaatctatttttagctctttgaagaccgtcatactgttttccatagtgaccataccatttcacctttggaggacatcttatagcaatgctttgttgtccccttttcaccacgattatgtggccattacttcttgttttcaaaccttgagagtgagctcaggttaaatttacacttccctttgtgccctggatcccaactggtcaaggtgaaccacacatttctaattggaatgtatgaccccagtgactttgcctgtaacttccttttggctaggccagtaagcgcatttttaaccaaaccgaccccattatcaacaaatgcttgcactgcacgataaattcagtttgctttaataaattcccagtagtcctcacccagagctccttctcctcttatctcactccttgctgccaaaccctttacaatttatgtgtctgcctttcggttctgccttcagccccctccaagtttcctctttcccaccagctcactgtggcctttgtgtctcacataaattttgtcttctgtgtctgaaactcttactgacttctgcttccttgttc

SEQ ID NO: 336219 - DNA, 277 bp, Homo sapiens
tcacttctcactgaaagaaccagagcccacatttgtatggtgcttttgactacataggcaaaagacactacgtggaaactgctctcatttacaggaaacggatggggtggataatacaaacatcatcaactgcctccctcttcccttcactagaatttaagaaacatttggttagtgacaaaacaaaaacttgaaaagcagaagttcacagctgaaacaggacttgaatatgcatcaaggaacatgttatgagcatcatagtggtcagtcctaaatg

SEQ ID NO: 336220 - DNA, 437 bp, Homo sapiens
tcaacagagagataagagtcattagtctcacagaagcagaaattaaaatagcaatgagagctgagtaatgcctagtgttggtgggaatgtggtgatgggggccatggaaacccgcacatgttatgaatgggagtgaggcttggtgcagcctttctggagggcagcccagtaaccccacccaaggtgtacatcaaagagattcttccacaggtctgtgaggaacatacacaagaatgttgtttgcagtagtacgatctggagccaattgaagtggctgtcatggagtaatggctaagtcagattccacaccatggaattccatagagcacagagcagcaatgggctcatccagcaacacaaataggcctttcaaacatcatgctaagcaaagtaaagggaaaaaagaaaaaaggaaaggaaaaaagagagaaaaggat

SEQ ID NO: 336221 - DNA, 449 bp, Homo sapiens
cgggattttgccatgttgcccaggctggtctcgaactcctgagctcaggtgacaggtgatccacccaccttggcctcccaaagtgctgggattacaggcacgagccacacacctggcttatttcctggaattctttaagtgaaaggcatggttaaacattatggcatcagtgaggtagtggtgtggggttttttgttgttgttttttaatttttgtgggtacatagtaggtgtatatatttatgggatactttgatacaggtatgcaatgcataataatcacagggtaaagggggtatccatcccctcaagcatttattctttgtgttacaaacaatgcaattatgctctttatttttaaattgaggctggacacggtagctcacccatgtaattccagcactttgggtggctaaggcaagcgtattgcttgtgctcaggagtttgaga

SEQ ID NO: 336222 - DNA, 84 bp, Homo sapiens
tgagaccatgtcttcagggggaaaaaaaaagcgctgggcatgggcatatacctatagtctcagctactctggaggatgaggtga

SEQ ID NO: 336223 - DNA, 679 bp, Homo sapiens
tctacggatccttaacacgcatctcaaacatgaccttcttcacatggcggcaggagagagaaatgagagcctaacaaagggggaaatcccttataaaaccgtcagatcttgtgagaacttactatcatgagactagcatgggggaaaccacgtccatgatttgattacttcccaccaggtccctcccatgacacatgggaactacaattcaagataagatttgggtacagacacagccaaaccatatcacccagttaaggagaacaggggaggttgagctaccagatgaggtttaggaaatggagtcaaagtaaacggaacaagattaggtaaggttaagagaatgaggttgattgaagttgtgaggacaaggtcagttgaagtcaagggaatgaggttaaaagaaggaggatggttaaggtctgtaggaggaagatgagaggacatggttgaggtgagaaggatcagaagacaaggcttatgacatttagaggccgaggttggttgatgatgttgaaaagtcaaactcaggtgatcaagagtcagtgtttgggtgaggttgagttccagttaggtagagaggatgaggtaatgttgagaggagttaagaggttgagttttgttcttcaggattgaagatcaagattgtttgagctgatagtggttgcatgggttgaga

SEQ ID NO: 336224 - DNA, 689 bp, Homo sapiens
gcctcaggaaacttagtcatggcagaaggggaagcaaacatgaccttcttcacatggcggcaggagagagaaatgagagcctaacaaagggggaaatcccttataaaaccgtcagatcttgtgagaacttactatcatgagactagcatgggggaaaccacgtccatgatttgattacttcccaccaggtccctcccatgacacatgggaactacaattcaagataagatttgggtacagacacagccaaaccatatcacccagttaaggagaacaggggaggttgagctaccagatgaggtttaggaaatggagtcaaagtaaacggaacaagattaggtaaggttaagagaatgaggttgattgaagttgtgaggacaaggtcagttgaagtcaagggaatgaggttaaaagaaggaggatggttaaggtctgtaggaggaagatgagaggacatggttgaggtgagaaggatcagaagacaaggcttatgacatttagaggccgaggttggttgatgatgttgaaaagtcaaactcaggtgatcaagagtcagtgtttgggtgaggttgagttccagttaggtagagaggatgaggtaatgttgagaggagttaagaggttgagttttgttcttcaggattgaagatcaagattgtttgagctgatagtggttgcatgggttgaga

SEQ ID NO: 336225 - DNA, 500 bp, Homo sapiens
acccagtgtattagtctgttttcacactgctaataaagacctactcaagactgggtaatttatacagaaaagaggtttaattgacttacagtttcacaagactggggaggcctcaggaaacttagtcatggcagaaggggaagcaaacatgaccttcttcacatggcggcaggagagagaaatgagagcctaacaaagggggaaatcccttataaaaccgtcagatcttgtgagaacttactatcatgagactagcatgggggaaaccacgtccatgatttgattacttcccaccaggtccctcccatgacacatgggaactacaattcaagataagatttgggtacagacacagccaaaccatatcacccagttaaggagaacaggggaggttgagctaccagatgaggtttaggaaatggagtcaaagtaaacggaacaagattaggtaaggttaagagaatgaggttgattgaagttgtgaggacaaggtcagttga

SEQ ID NO: 336226 - DNA, 415 bp, Homo sapiens
ggaagaggggggttctacgagtagcgcaggagggaggcgaggcaggcaccgcagagcttccagctgcctcagggccgacttccatttggcactttgagtccaaggtgcctgtgcaccttgtccagatgctctggaggtggttgctcgggtatgtgggtctgagactccaaacagctcggccaaagccgacatggagatccatcagttcacaagtagtgaatgagccttctcaggtgggtggcagtcccagggtggccaagggtccagggagtgcaccctcactctgcaggtgagtcagaatcaggcaccacagagccagggttgcacccctgctggggggaacaggagccccttttcctctccccgacacacagggacaaagttatcatgctctttgggtgccactgggaggcac

SEQ ID NO: 336227 - DNA, 490 bp, Homo sapiens
catctcaaaaacaaaacaaaacaagaatgatgaccaaactatttttaatacttaccgaataaagtttttgacttgatttttatagatattttctactacttattttcatatgtgtatataaatggaaattcaacattatgtaaattatgaaagaggcattataattttaagtaaattcattttgttctaaagcagaacttttgtttcttactcagattttctgaggaaaaggagtattattctcaaggtttgtatattaacaaacgcatgggagaccactaacaaatttcttctcagatccagattgcggtgtttgcaaacaccggcaatctcaacccttctgctgggtgatcgggaaccagcaatgatcggccctcagcagggcacaccccgaacaaggaggccagcagcaacaaggtccaccacctcctcagggaaagccacaaggaccaccctcaacagggaggccaatcccacctcctcctcaagg

SEQ ID NO: 336228 - DNA, 553 bp, Homo sapiens
tgcggatttcacctagttgaagccaaaagccgtggaaatacattaccacgtggaagatgtggaactccagtatctcactgcctgcatggccagcccctaaataaattatcaatggtggccaagtgactactgggtgctttgtgggagaaacagctcttgctacaaaatccaaatgaaaggcatgaagaatccaaggactgccgggtgcgcttgctacttctaactgccctgtacagcttaaagtgaggtaataacacactctgtcctcacagggcctctctaccactctacataaagtacgagtatctcttctcttctgcagccacaggcctgagatatcccagaaccaaaagcagtctgactccaccaatctgcagactggcgcattatacagccagaaggatgtgttgtttccttgctccttgagtgacagtcagggtatggtttgggaaagagtggaaccctcaccttaggagtggggatgcactgggggctcacaaccccactgaacccttgctcctctctctggctgcttcaggctgttatgccctcc

SEQ ID NO: 336229 - DNA, 175 bp, Homo sapiens
gggagagtgcagcactgggtgggagggcgctcctcgggctcagtcagacgcatcagccttcagacagcttctggaagcaccagttgtgggtatctgaaccccccacaggggagaggcatctccccaaaattttccatggaacttaattagcctcaaagccaataaaatcctcgtg

SEQ ID NO: 336230 - DNA, 300 bp, Homo sapiens
actccttaaaaatatctaaccttccattatagttagaggtgatcctatgacaaattttgaccagtgaaatgaattcactgcatggagtttttgaataataatttaatggtaactgattctgttgtcatgggaaacttgtctttttccttacttcctgaaatgtaagtagaagaggaaaaaaaattaaaaatagaaacaataaaataagaacttacatatgacgtctttgaactgttgaacaaatgccaatatccaactatgttggacttctctgtatatggcagaaaaaaaatcatattt

SEQ ID NO: 336231 - DNA, 585 bp, Homo sapiens
atgcccctctactgtgatccaattatagtttcgacatatttgtttcttatcacctgtatgttatagtatattgtaattgtctgttaattcatattccctctcacacctcttcactcactttaaccattccaggcaagaaggaagacggttgcttatactatgccaacattttgttgttcttgtttttgtttctagaacaaatgctggaaattctttgacataacttccttcaagagttgagctttatttttttccaccccttatgttaaggcaggagtatcacttgcttgtaaccaacagaatgtagctgtgtgatttctaaggttaggtcaaagaagtgatgccagtttttcttgttccctgggacgtttgttttgggggccttgttttaagaggtctgactgccctgaggtggccacactgtgaggaagcccaggctataggaagaggccaggtgtaggtgctccgttgaggccccactggggtgtctgcatcaaccagcaggcactaaagacacctctatgtgattctggcctctagctgtcttgcaaccctagcctttgaaactctcctggccaatatccc

SEQ ID NO: 336232 - DNA, 159 bp, Homo sapiens
ctgtgaggcactggaagagtccagcagctgcgggagggagtgtttccggccatctcgggagacctccaacatccggatccgggggtccccattccgcaccatcagctcgttatattcttcaactgactcaaggcggtgtacacccccttgagaaaacag

SEQ ID NO: 336233 - DNA, 347 bp, Homo sapiens
atggggctgcagggaaggccttctcaactcctctcaggctgatggtgagttagagaccagccagggaaattgacatctgaggcagatctggctgagtccaccaggggaagagggtgggatggtggagggaaggggcttgaaggaccgagtgtagagtcctttgtcacataggaagatgtccgtgctttgtgagcaggcaggagtcttcgaaggttccaaagcagggaaatgacataagactactgaaggccaggcatggtggctcacgcctgtagtcccagcactttgggaggccgaagtgggtggatcacgaggtcaggagtttgagaccagcctggccaacatgg

SEQ ID NO: 336234 - DNA, 114 bp, Homo sapiens
tggaggcccagtcagcccttccaccctctttggctctggtgggcatctcccccaaacctgagagccccaccgggcacacttggacttctttacttcatacaacccttccactcc

SEQ ID NO: 336235 - DNA, 260 bp, Homo sapiens
ccagaggataaagttgtgtttattttttcctcataaaaacaatatagctaacgtgtgggaagtttgggattcagagagaaccaaccacccatggcccagccctcatgactgtccttttccctttgacttacctctctccagtccatgcccaagttcacatgaatgtttacttaattgcagtcatcatcaaaaaaatttaatcatttttttacttgcgttatgtacgtgtgtgtgtgtgtgtgtgtatatacttttttttt

SEQ ID NO: 336236 - DNA, 466 bp, Homo sapiens
ttccttccagagtactgctgctccttcaatgctggggactcagaggaagtatgaaaggaaaatgtattataattaatgaccaataatttttttaaagttttaatttagggaaaatattcaaggttgtaccagcctgtactataacaatcaactaacactaacaaagtagcaattttctgtcccaggccatattagcataattactagactctgaggaccaaatatctcatgggaaagagtaaccagtgtacccgtgaactttctagtctttctgttcacatccagcccctatccatgattctggccaatgcgttgactcctgttcactgctgttcctccagagagcactcactctgcttcatgtcctcccactagcagtctctcagctgacagggaatctgctccccaacctgtgttgcccttttgtttcagggctcaaattgccccaagttctgccttcagccat

SEQ ID NO: 336237 - DNA, 523 bp, Homo sapiens
ttgaaacttgtgtgtttgtgacttgaattcaggggagtgggtcctgcattgaaaaggacacgtgtgtcactcatgcggcctcctgggggctggtggtggcccaaggatgtcttcattcctcagcaaacacagagggctgcaggcttcccagggatcaggcactgccccagcggggtgctggagatgcagctacgggtgggacctcgtggaactcgtgctgagggaagacagtccatagaaacagaggggagtgcaaagcaggagtccagcagggtggggcgggaggcttggagggacaggccccgtcaggcagtgttcagggaaggcctgcccgctgaggcagtgttgccggagaaccctgggtagggagacgtgtcctggcctttggtcctcccagacgacgtgggcagcgcagaggcaccagattctcttgaggaaaactgcacctgtccttgtcctctctcatctctctgccacccgcgcccgcttgtccttctctccacccgacattcagttcccacag

SEQ ID NO: 336238 - DNA, 644 bp, Homo sapiens
tgacacccagtttgcactaggtactccctaagcattcttaacatttcttaggaaagggcccaggatatcttctgaattagggactagagtattttattttctccaaataatcaaacccacaataattttcttgtccagaagacaagaaaatctggagaaacttagggtgcatttgtaaattctggatttgcagtgctaagctggaaaaggtcaggtcttctacatcactttaacaatgccatgcagccatgtgctggcctcatttccaacaacaaaaaaagaagaaacaaaagctgcagatccctttgtctgaattttctgacacctattttttatagagtgatctttcttttcctcctggcttgatcacgtcactcatggtgctcaagagtgcttcatagggagatcagcgactttctcaagcacgtgattggatggcacataattctctttggctgaaggagcagtagcttctttacagttgaatagatttcatagtcagcaatctcagaattatattagaagataatttcttgctgactaaacaaatcatggtacaatataagttagacaccttctctggaattaaagcagccttggttgctctaaatataaaaagagaacattgacctttcaatactgac

SEQ ID NO: 336239 - DNA, 164 bp, Homo sapiens
ggtgatgatgttacatgaaacctttgtggccacctgacccaaccatttcatattgaggacgtggaaagtaagtgccagggatattagatgactcctttcctgggtgattcattgcataccttttgttaacgccttaccaatatagttgtttatttgtgtgtctg

SEQ ID NO: 336240 - DNA, 191 bp, Homo sapiens
gatgttgaactgaatggtcttgctgctcttccttccttcattaacatgagaacagatagttgatgcctctgatgttcatgttgttcccattgcccttttctctttaagcgcactgcctagtttcctttaaagtcgttgccttctttagttttctttttaagctgtttctgtgtgggctagtgttccctttt

SEQ ID NO: 336241 - DNA, 332 bp, Homo sapiens
atctcctgactctctacttcctaacattgtttctatatcacattatattaatatttcttttctatgccccagagtttacaataatgttcggcacataataaatgctcagtgaatcatgccgattttgatttcttaaagtgttttgtctaacacactgtgaagcatgattccatattttcctttcatatatttagttatacttttgcacctacacagatgacatatggctggtcatatagcactgctctgctgagaactcaatatgtctgcatttcttctgtcatccttcttccatctctccccaatctgtgcgcttaaaaataaaggtgcag

SEQ ID NO: 336242 - DNA, 247 bp, Homo sapiens
ttttcacacaggcacaaacagtaagacaacgtattacatttgttaagaggacgtttagggtgctgtggggttctgggctgtgattcagccgctggcgatgctggcaggaaaggtcctccctccctctgcttggccatcctcagtggctacatctgctccccttgtagttgtgagatggcttcaggagttctgggtctcaaacccagacatttgacatccagggaacaggacagaaacagaccatctc

SEQ ID NO: 336243 - DNA, 392 bp, Homo sapiens
cctggaatttgttttctcctggctttggcccaagggtgagctgaatcatgagacctcccagcagtcatagacagcaacaaccccaagaaatggcccatctttctggatagataatctggaaaaggggcctctgcaagacaaaaagtgtggggaaaatctttgtctttttttctctctcagcttggacacacagtcagatgcagcccccaaactgtatcgccatcaccttggcagcagcttgagcactaaaatctcaagagaaaacctgtccctttgggtacagaaattcagaaaaggggtccctgttatgtcaaaagtatcaggggagtcctcacttttttccccttgcactttgctctaaggtctggccaagtggcatgaaactttgtgac

SEQ ID NO: 336244 - DNA, 513 bp, Homo sapiens
agttaaccaaggaggaagggaaggaagccagcgcttccttttcagacaggaagtaacattggcccttcctgtccagttttaaacaaattgtccagctaaatttcaatgctaacatcctctcctgaatttgttccacaatttaaaaccacagatacagtctaaagttttcccttcctcccaataggcgagtcctccataccatgctaagtgttggcataacccccaaatcaagaggtaacatctttaattccaaaacaatacaggacacagaggtaaatcacttcacttcaaattaacgaccttctcgtcatgtctactacaataaaccatcttctgtacttctcttgttttgtgtgtgtgtgtgtgtgtgttgttttttttttttttcgagacggggtctccctatattgccaaagctggtgtcaaactcctgacttcatgatccggctgacttggcctcccagattacagtcttgagccagtgcgcccgggcagaattttatcttacagcct

SEQ ID NO: 336245 - DNA, 92 bp, Homo sapiens
ttcaagatgctgtcgtttggggtgtctgcccttggcaagtccatcgaggcctcagcggatgtgtctgcgttgaaggtggaggccgacgtgag

SEQ ID NO: 336246 - DNA, 759 bp, Homo sapiens
ctctccctcgggctgctggttgctgactttggcgccatggtcaataacccacacctgagtgatgtccagtttcagacggacagcggggaggtgctttacgcccacaagttcgtgctttatgcccgatgcccgctcctcatccagtatgtgaacaatgaaggcttctccgctgtagaggacggggttctgacccagcgtgtcctgctgggtgacgtgagcaccgaggccgcccgcacgttcctgcactatctctacactgcggacactggccttcctcctggccttagctctgagctgagctccctggcccacaggtttggcgtgagtgagctcgttcacctgtgcgaacaggtgcctattgccactgactcagagggcaaaccatgggaggagaaggaagcagagaattgcgaaagcagggccgagaatttccaggaactcttgaggtcaatgtgggcagatgaagaggaggaagcggagactttgttgaaatccaaggaccacgaagaagatcaagaaaacgtgaatgaagcagaaatggaagaaatttatgaatttgcagctactcagcgaaagcttctccaggaagaaagggcagcgggtgccggcgaggacgctgactggctggagggtggcagtccggtttctgggcaactcctagcaggtgtccaggtgcagaaacagtgggacaaggtggaggagatggagccgttggagccaggaagagatgaggccgccaccacctgggagaagatggga

SEQ ID NO: 336247 - DNA, 516 bp, Homo sapiens
tgtcctgaacgaaaataacaaggaaccccaagagtgtatgaccatggcaccccactttgctgaaggactggacagggcatctcagaggaggtgatggttgacctgaaggcctaaagggtaagtaagaactaaccaggcaaaggggtgcgggagaagggcagtacaagcagagggaaaggcacacacaaaggccctgtggaaagtggaaaacatggtgaggtcggaagaacagaatgaaggccagaaggactggagaggggatcatgagagagagctggcttgagacgaggccggggaggcaggcaggggtactctgcagggccccaaaggccatgataaaggcttctcctgttttctaaaagcagtatgtagcctctgagatgtgtaagtgggctgtgcatacgtgtgaaagagacaggccctgtggaactctggctacgtgtgaccaacagattgcgggtagcagggatagaagtggggagcagatgagatggatgctcatgagtcacaggtacc

SEQ ID NO: 336248 - DNA, 406 bp, Homo sapiens
atcacccaatgcaggcatctgtcctcaataaccatgacaggtggacattcagacacaacctggacacttaccatgcacagtggcaaaagttcactactcccaactactgaatctagttcttccttcagccatatgcaaaataaatataatttctttcaggtactcttcagatacctaaaggaaacaccacgtcttttttccattttaaatagtccagctttccttagcatggttttcagatgtcttaggatcctggcaacctcgttctattcataaatgagaactgaacacaaaacagtaaattggatcctcattctagacattatatggccactaatgaaatctattattgccctagggagtgccagggagtgcggggttggcacatcacactattaagtttgca

SEQ ID NO: 336249 - DNA, 351 bp, Homo sapiens
cactagcatctgaaactatatccagaatgacactggttttcataaaagtgttgatcctcacacctctttatagtcttgcacctagcacagtggagtgaaacactttaaatagcacttgttccttgagtatatatggaaaaaagtgaagtattgataagtgctcagctaatatgagcagcatctcaggagtctccaattcttgaattaccagggagtatttttaccattttcccccagtgaaaggcctattttgagagacttaccctccaaaatgaatgtattaagtcatgttccttttttttttttttttttgagacagggccttgctctgttgcccaggctggagtgcag

SEQ ID NO: 336250 - DNA, 312 bp, Homo sapiens
agtccagaatagtgggtgtattccattttgatctgcatatcttattctgttgttgattaagagcagtgagagtccataaactatggtatatgatagctgtgatctctgatacaagcttcatgtagatgacactcaaatctgcacattcagcttgcacttccctactgcctgctggacatctgcattttgagatcccgctggttcctgaaacctagtgtgtcttctaccaaagtcattggcattttgcagtgatatttttttgcattcccataaacctatacctcctctagttttacttatcttgattaatgg

SEQ ID NO: 336251 - DNA, 422 bp, Homo sapiens
tcactttccttggggcatttgtttccttttggtgaattccagaatattacttcccaccttcaaataattcattttttacctgtaaaattttccatctcgaatccagccgaatacagataagggaccttgatttctacaccccttcttgtttctgcttttgtttttcatttgaatcctattaaagccaatagatatggcaacgttggcaaaaatagaagcaaaacgtaggcgtgcggatattgatgccctccaccttcctgccagcctctatgggggatgattacctgctctcctcatctgtaacaaggctctttcaacagcaccttcatctgctacattacttggaatgcacatctcactaaacggtgcccctcatcaaactccatacaacacttccttgaattttactatcataaacagaa

SEQ ID NO: 336252 - DNA, 229 bp, Homo sapiens
catcaaagccgcttggctcattccaccacttctctcctgaaatgccgcagcagatgttgagctggtcccttcatgcgtcattctgacacccattcccacctattcttcacactgcagccggagcaaacggggtggtcccagctctcccacccaacctcaggtcctcgggttccatcaagctccccaggatccagactctagcccacccaatcgggagctccaggcttgg

SEQ ID NO: 336253 - DNA, 559 bp, Homo sapiens
tgtgaccacagtcaagatacttaacctctttgtgctccagttttcttatctgtaaaatgggctgaggattaaatgagctggtgtgtagaaagcatgtacagagtagctggcacacagcactgaatagtgctgcaccatcttcagatctaaatgatacaactaaagcatcaccattttcaggacccgcaatgcaagctgtgtgctggtgatacgactgatttttcctggctgcaaatacacacacggctctttccatactacctacttcatactacctactgtacaccagcctgggtcacgaatgtgtattcatgggctggatcgggaagagagcggtggccatgactgtggtaaagatgtctgatctggacctagatggtaccctgtccttggtcccccagcatctctctggggctgacctgccaggcaactgagcatcagtactcctatcagacgaatttctcaattgtatccaagtgttaatacatgctttgaaagacggccagaagaatgccctgagaaccatcagaaagcaaagattagctccaggtgaggcagt

SEQ ID NO: 336254 - DNA, 301 bp, Homo sapiens
tgcggttgtcaccaccggggtgggggaagcccaaggatgctgctcatcactcacagagcttggggcagccccaccaccgagggcgggccaggagacgccaagagctgtgcctttcatcgcctggggtcccgggcaccgaccgccgccgggtgtcgctccgtgttcgtgtacatgccttctcctgggggtagccctgcttttatttcctgagtgcttcctgggaccatgcatgtccggcaggccctggccaagatccaggcttgctgcgtgcagtccccgcccactgtgtccccctgaggga

SEQ ID NO: 336255 - DNA, 501 bp, Homo sapiens
tgaaggtggtttgtagtcattcactcatccctttacctgtctgtcagtccatccaccaagtcgtcaatctggtcattctaccaacactcatcaaactcctgccagcctcagatgggttgaagacggcaatgctcgactcccacccacgatgaacagcaatgccagctgctgtttatggagtcccatctaaccaggcttgctccaacttctttcatccctatagctgttactatgcccattttacagatgaggacgccgaggctcagagagcctgaggccaggacccagctcaacatgagtggcccttctggctgtggggccacgtccctctccctctggctgccctgaagtcccctccctcctgccttcacaggcaacgtctcgctctccacagcccccgcctcctgggttcaagtgattctcctgcctcagccttccgagtagctgggattacaggcatgcaccaccatgcccggctaattttgtatttttagtagagat

SEQ ID NO: 336256 - DNA, 101 bp, Homo sapiens
gctacacggaaaagaatatggggtatttaatttacatttggggcagtggagatgtgtcctggaagtcgtctttgaaatactttgaaatttatgtcaagacc

SEQ ID NO: 336257 - DNA, 1162 bp, Homo sapiens
agggcagtgaacctaagccaggagctgcttaggcattaaggcttctatacccagaatcgtgtgctaagctttctctccaagtcagcacaacaaagcaaaccagagcatcgtaccaacaacctgaaaggtcacctgactccttccttctcactcccattctgtacttctgcatacgtgggcaggcaagtgaatggtaagtaagcctgcaaacagcctttctttgtatagggaatgacaggcatttcatcagcaactccaggatggcaggccgttatcctgaaacctatcagaacagctcctgcttggcttccaaaatatcacaattttggaaatgtacaaaggttagttttcacagtccttgaagcctctttccaccctggccatagcccatgtcagcagtaacctatgtctttgttttacatatcatgttgttttactcacctggtgcctccagtgccctatagggtccctgagctgtcctgatactctttcttagatcctgtcaaaacactcacttcaacaaattctgcccttggactctgatgggaggttctgataaagaaaattattgaaaaccgcattatttaaatgtggttatatttcagctggacctggaaataaagacgaaatactgcttcgtgactgtgctttaaggaatttttgcttctaggagatgattgtgagccaggcagaggtgaaggagcaggagcaaatagccaaggcacagttcacagtgctggattttcttgtggatatagctgcattgttgttccttctgccttgtccaactgcttcctggtatccctaccctcaccttttcgttatcttttcatctctctaatcattgagaaaaagagtacaaaaagccagattttgcagttccctattttgtattccaggttgaagagtgctctggctgtagagggtccccacgatctgtcatctagtaactcaccagatacataagatattttgcctgctatgaagccattggagaatcaggtccagctgtgtcctacagatttataccctcactttggatgcactgtgaatcttgaaacaagtatgtaaatagaatccagcccctctctgccacagcctcagagcaggattggtaactccaaaagacaccaggacacatcctaattttcttaaattttat

SEQ ID NO: 336258 - DNA, 1628 bp, Homo sapiens
agggcagtgaacctaagccaggagctgcttaggcattaaggcttctatacccagaatcgtgtgctaagctttctctccaagtcagcacaacaaagcaaaccagagcatcgtaccaacaacctgaaaggtcacctgactccttccttctcactcccattctgtacttctgcatacgtgggcaggcaagtgaatggtaagtaagcctgcaaacagcctttctttgtatagggaatgacaggcatttcatcagcaactccaggatggcaggccgttatcctgaaacctatcagaacagctcctgcttggcttccaaaatatcacaattttggaaatgtacaaaggttagttttcacagtccttgaagcctctttccaccctggccatagcccatgtcagcagtaacctatgtctttgttttacatatcatgttgttttactcacctggtgcctccagtgccctatagggtccctgagctgtcctgatactctttcttagatcctgtcaaaacactcacttcaacaaattctgcccttggactctgatgggaggttctgataaagaaaattattgaaaaccgcattatttaaatgtggttatatttcagctggacctggaaataaagacgaaatactgcttcgtgactgtgctttaaggaatttttgcttctaggagatgattgtgagccaggcagaggtgaaggagcaggagcaaatagccaaggcacagttcacagtgctggattttcttgtggatatagctgcattgttgttccttctgccttgtccaactgcttcctggtatccctaccctcaccttttcgttatcttttcatctctctaatcattgagaaaaagagtacaaaaagccagattttgcagttccctattttgtattccaggttgaagagtgctctggctgtagagggtccccacgatctgtcatctagtaactcaccagatacataagatattttgcctgctatgaagccattggagaatcaggtccagctgtgtcctacagatttataccctcactttggatgcactgtgaatcttgaaacaattcattttatacttaaccctttaagtataaagtatatacttcaagtataaagtgtaaggttgcttcatttcatgggcccacccaggatttaaaggtgtattccctgaaagaattggttccttccggtgggttcctggctgacttcaagaatgaagctgcagacacttatggactgggaggaggcccacgagaaaaacaggaagaacaagagaaaggctgaggctctagtggctgctttgcagacttgcagagtccaggatcccccaggaacttccactgattgctacctgttaccagtgttaaagccagggcactttaagaagaattgcccaagccacaagaaaaagccaccttgaccacttttgtggtgaagaccactggagattgcactactgaccaccaagacagagacacaatagcgaatctagaagtggaagtgtgagagatacctgcagctgttaagatgtctgggaatagacacacaaactctctctcccagataagcaacacaaagcagcacagagcaacagagactgaaagtctgcctacctgatcagggaataag

SEQ ID NO: 336259 - DNA, 840 bp, Homo sapiens
aacagactcagtgctctctgtgccagtttgcctgcctgcttgcctgctctttagcaagtaacctataaatattcgtggtctatgaattctctctttgatgatgtatttacttcttggttagctgttttatcacttaatctgccatcagttcaagagataaagtgcatacaaatcgtaacctgactaaaaaagtgggcaccatttcattcatttcttcaacagatattatctagataatagttcaactgctttactagttaaatcttgtagtcaaataggtctagtaatttgacctgttccccattacattttttttgagtgagtattataaaatgtacatggtaaaaaaaaaatttaaatagttcaaaacagtatactataaaaaaagttggccgggggcggtgactcacgcctgtaatcccagcattttgggaggctgaggcgggcggatcacgaggtcaggagatagagcccatcctggctaacatggtgaaaccccgtctctactaaaaatacaaaaaattagccggccgtggcggcgggcaactgtagtcccagctactcggggcaggagaatggcgtgaacctaggaggtggagcttgcagtgagcagagatcgcgccactgcactccagcctgggcgacaaagcgagacgccgtctcaaaaaaaaaaaaaaaaaaaaattccctcgtatatccagctctgagacttttagttccccttccctggaggtaaccagccatcatttttttgttgttgtttactcttccaaagattccatgcattcataaggatggatggatggatagacagacaaaccaaccatcatttcctttaaa

SEQ ID NO: 336260 - DNA, 281 bp, Homo sapiens
tgtgctgtagtaaagtttggagtttaatgcacagagatgtttgaacatttagctcatcctttagtctgtgaccagctttgctacgtaggcattaacctttaatagtgtcagactaaatatacatgccatgatgaatgattatgagtttgcctgaattttcatttacagtgtaaggctctgaaaattggtgtaaaggtctggttcctcctcacttgataatgtgcgtgtcattttcatatgtcaccggattccttgcttaaccgcatgggagaagctatttt

SEQ ID NO: 336261 - DNA, 288 bp, Homo sapiens
catcagatgcttcaagtacaaaccagagctgaggattttgaatagactccatttagtttctcttctggaggcccaacccacacaatcctaatttctctgcctcttaagttgatgccataaccaagtactgtggagacatcaaaagatgaagacaaagaaaacatacagaattggaaggttaggttaaggctgttcactgggactgaataatccctaaaagtctctagtaattctatgattagatgattctaattattcctaaataaatgttcctatattggcaatttg

SEQ ID NO: 336262 - DNA, 233 bp, Homo sapiens
tacaaagtgttagtatgaattatacagttataacgcagtgagaggcgtccctattgatgccataaccaagtactgtggagacatcaaaagatgaagacaaagaaaacatacagaattggaaggttaggttaaggctgttcactgggactgaataatccctaaaagtctctagtaattctatgattagatgattctaattattcctaaataaatgttcctatattggcaatttg

SEQ ID NO: 336263 - DNA, 876 bp, Homo sapiens
catcagatgcttcaagtacaaaccagagctgaggattttgaatagactccatttagtttctcttctggaggcccaacccacacaatcctaatttctctgcctcttaagttgatgccataaccaagtactgtggagacatcaaaagatgaagacaaagaaaacatacagaattggaaggttaggttaaggctgttcactgggactgaataatccctaaaagtctctagtaattctatgattagatgattctaattattcctaaataaatgttcctatattggcaatttgaatattttctttttatacatacacatgtgcatgtgcattttcctctacacatacacacacactcacaaatggttaattctctaaacaagatatacattggtaatcattgaattatgattattttctagtaaagctttttaagttttaggtgcttttctgataatccactgacctagagtattgccaactttgcaaattatgaggatattgggtaatttatctgcattaactaaatatttttaaactgttgctattaactctttctgtatctgattataaaacaccatgtcaccagatttattgggggtggagttgagatgcatgtttcatatgccattcctaatatttaagttggtaattttaaaagtacacttaaatatttctattgtcaggagtagaaatgtttctttgcacatcaattcctctgttatatctttctccaacagttgaaaatcatgacctaaggcaaaatgtaaattttatgcctctcctaatagatgtcgtgtttatagaattaggctgagtgttcctattactgtgttgtcctcagtgaatacttaaactgcttttgcttactacagtcaactc

SEQ ID NO: 336264 - DNA, 1019 bp, Homo sapiens
  misc_feature (940)..(940): n is a, c, g, or t
tacaaagtgttagtatgaattatacagttataacgcagtgagaggcgtccctattgatgccataaccaagtactgtggagacatcaaaagatgaagacaaagaaaacatacagaattggaagccctgcctccccaaggcacagacagagtctcctccgtcttacttgagctccaccaaactcaggaagcgtgcaaatactttcatcctgccagcttcactctggaactttgctttcttggctactatggaagatctaactctagaagtctccatcaacaatttggaatgatttttgcttacctgtgacacccagaaaaaaacaacgttcacaattttacacagaaatcagtgacatgcgtggaaagaaaatggaacagaaggtagaaacctgcgttctggaattagactgccggcgtttaaagctcatctctgccactaaccacttatatgatgttaggcaaattagtttatctctctgtgctactattttctcaaaagtaaaatgtgagttgcaatgtagtttgtttaactcgaaaattttgagatttgaatataacattcaaacgctaagatgtgtacctgacacagaataaatgctcaataacaataatctcttttttaaaaatgcacaaaatgtagaaagcaatacattgaattccattctttaaaacgagcacatatctaaatgctgagtaatttcttacggagaccttacagatacagttcttttttctattgtttccccggaattattcagaaaagcattttctttaagcaagttctaatggctgtcactatgatttaaagctttctacagaatctttcacatagggtatgcctgcctaaattactttggacctagttttagataaacttccataacaagtgttgataaacgcatgagtaagtaaataaagcaaaacagaatttaacaaaaanaaaaaactggtctccttgcgccccagtggtggagctttgaggaaccttacctttaggggagggttaatcatgatcctcg

SEQ ID NO: 336265 - DNA, 954 bp, Homo sapiens
  misc_feature (875)..(875): n is a, c, g, or t
tacaaagtgttagtatgaattatacagttataacgcagtgagaggcgtccctattgatgccataaccaagtactgtggagacatcaaaagatgaagacaaagaaaacatacagaattggaagccctgcctccccaaggcacagacagagtctcctccgtcttacttgagctccaccaaactcaggaagcgtgcaaatactttcatcctgccagcttcactctggaactttgctttcttggctactatggaaaaaaacaacgttcacaattttacacagaaatcagtgacatgcgtggaaagaaaatggaacagaaggtagaaacctgcgttctggaattagactgccggcgtttaaagctcatctctgccactaaccacttatatgatgttaggcaaattagtttatctctctgtgctactattttctcaaaagtaaaatgtgagttgcaatgtagtttgtttaactcgaaaattttgagatttgaatataacattcaaacgctaagatgtgtacctgacacagaataaatgctcaataacaataatctcttttttaaaaatgcacaaaatgtagaaagcaatacattgaattccattctttaaaacgagcacatatctaaatgctgagtaatttcttacggagaccttacagatacagttcttttttctattgtttccccggaattattcagaaaagcattttctttaagcaagttctaatggctgtcactatgatttaaagctttctacagaatctttcacatagggtatgcctgcctaaattactttggacctagttttagataaacttccataacaagtgttgataaacgcatgagtaagtaaataaagcaaaacagaatttaacaaaaanaaaaaactggtctccttgcgccccagtggtggagctttgaggaaccttacctttaggggagggttaatcatgatcctcg

SEQ ID NO: 336266 - DNA, 947 bp, Homo sapiens
  misc_feature (868)..(868): n is a, c, g, or t
catcagatgcttcaagtacaaaccagagctgaggattttgaatagactccatttagtttctcttctggaggcccaacccacacaatcctaatttctctgcctcttaagttgatgccataaccaagtactgtggagacatcaaaagatgaagacaaagaaaacatacagaattggaagaagatctaactctagaagtctccatcaacaatttggaatgatttttgcttacctgtgacacccagaaaaaaacaacgttcacaattttacacagaaatcagtgacatgcgtggaaagaaaatggaacagaaggtagaaacctgcgttctggaattagactgccggcgtttaaagctcatctctgccactaaccacttatatgatgttaggcaaattagtttatctctctgtgctactattttctcaaaagtaaaatgtgagttgcaatgtagtttgtttaactcgaaaattttgagatttgaatataacattcaaacgctaagatgtgtacctgacacagaataaatgctcaataacaataatctcttttttaaaaatgcacaaaatgtagaaagcaatacattgaattccattctttaaaacgagcacatatctaaatgctgagtaatttcttacggagaccttacagatacagttcttttttctattgtttccccggaattattcagaaaagcattttctttaagcaagttctaatggctgtcactatgatttaaagctttctacagaatctttcacatagggtatgcctgcctaaattactttggacctagttttagataaacttccataacaagtgttgataaacgcatgagtaagtaaataaagcaaaacagaatttaacaaaaanaaaaaactggtctccttgcgccccagtggtggagctttgaggaaccttacctttaggggagggttaatcatgatcctcg

SEQ ID NO: 336267 - DNA, 405 bp, Homo sapiens
gatgtgggacttgcagagctaaaacgaggatagtcttgtgaaaactgggatagttgatcatcctaccttctactgaatatttagatcatttcaaatatttacttacagaaacaatactgtgctgaaaattttggtgcctaggtatttagccacattttttttttcattatttccttaggtgagagtcgtagaaatggaattaatggctcaatgactgtggacatgttttggagctcatggcagtgctcatggttctttattgcattttttgctgtattcagctagactggcaggagtctgcctggacatttgcaccacctctgcctccgcaagttcttagggagatgagccaaagacttgttcttcactagctgcaacttgtgttccaaatctttagctggccag

SEQ ID NO: 336268 - DNA, 508 bp, Homo sapiens
tccctgaccaggaggctcagggtgagagtggatgaagcacaggcaaccagggattcgcaatgaatattttcgttattcatacccgtgtaagacagctggcccctccactcccgcctctaacccgaccctttgcgatttgtaggggttgtatcgtatgtttttgagaacggagtctcgctctgtcgcccaggctggagtgcagtggcgggacctcggctcactgcaagctccgcctcccgggttcacgccattctcctgcctcagcctcccaagtagctgggactacaggcgcccgcacctacgcccggctaattttttgtatttttagtagagacggggtttcaccgtgttcgccaggatagtctccatctcttgacctcgtgatctgcctgcctcagcctcccagtgctgggattacaggcgtgagccaccgcgcctggccaaaatatataaccttaagtgtaagtttactaactttggaaagtacatacaccagcataaaccaacc

SEQ ID NO: 336269 - DNA, 97 bp, Homo sapiens
agacagagaggccccagggcatcgtggctaaggttgggctcccctactccacagcctccaggaggggctgaggtctggaaacatgggcgggggtggg

SEQ ID NO: 336270 - DNA, 606 bp, Homo sapiens
ggaaaagctgcaggtcccgcaagacacagagcaaccctgcaagccaggtcaccttccctcttctctgctgtccgactggccctccaccatgtgacattcaaaagctcaagttacttaacctctcaaaactcagcatccttttctgtacagtggggaagatactggactgttgtgaggattaagtgaggagagtggcccaatgaggttgacagttattactgtcattgtcattattgccttctcacaggcaggcgtgccacagtcattttactgaagctgcttcagtgggtcctgaattaggccctgtcctttgggagagacagtcctggttcaacacacagctccctgcccagggcagcttgggagtgtgggccagtttcgcctttagaaccacaattctctgatatgtgcaatgagagaattaattatagactcaaaggattgcatgcagacacacacagatacaaacacatacacacaacacacagagttacacacagacatgctcacaatacacagaaatacaccaaaagatactcctcgagaagagcaacccagacacatattgtcagatcacccaggttgaatgaggaaaactgttaggcg

SEQ ID NO: 336271 - DNA, 389 bp, Homo sapiens
ggaaaagctgcaggtcccgcaagacacagagcaaccctgcaagccaggtcaccttccctcttctctgctgtccgactggccctccaccatgtgacattcaaaagctcaagttacttaacctctcaaaactcagcatccttttctgtacatgtgggccagtttcgcctttagaaccacaattctctgatatgtgcaatgagagaattaattatagactcaaaggattgcatgcagacacacacagatacaaacacatacacacaacacacagagttacacacagacatgctcacaatacacagaaatacaccaaaagatactcctcgagaagagcaacccagacacatattgtcagatcacccaggttgaatgaggaaaactgttaggcg

SEQ ID NO: 336272 - DNA, 478 bp, Homo sapiens
ttatagcaccagtggatcatttggttgtatgcatattattgtaccttctctgctacaaaatatattcctttgtcctaaggtgtgttacaaagaacattaggcattctatgcatctttggatagtttaatggccaaggcattgatggcaggagagtcaaagccacaggtggaaaacacatttatcccagtaagaacaaattgctattcttccactgtagagagggtaaacaatgtgccattacgttgccaattgaatgcctcaatcatgtcaagggctgaacatctatgactgtttctgaaaggtcaaacattcaacagaggctgtagctagaactgccttaatgataagagatcatgctgaattacccatgcaaaaccttaatacttgacacttatcactactttattcaagagcctattgtgcaagcataagtggctggtcgacgcggccgcgaatttagtagtagtaggcggccgc

SEQ ID NO: 336273 - DNA, 98 bp, Homo sapiens
gggaacagcaacagagctctattagacacctactatgtgccagcgccaagcacttcacgaaataatagtaaaagcatctatttattgaacacctacta

SEQ ID NO: 336274 - DNA, 360 bp, Homo sapiens
attcaatttatttttcaaagtgtttctggacaaagtaagacatttaataacatggaaagtaaccgctgaaaggaacaagaaaaggaactgcacctacagcaaaatctcacccaccagctcttccgcggcccccgtcacaggaaggtcatctccactcacaaacaagaagagaaacccaactggcggggaacacacaatcactgccggaacaagactccggggcttccctctgcatggaaaacaggactgagggttcttacccaataaacaatctcttcaaaacataagcaaaaggcaatacagatttataaaaaacacaagaaagcaaggcggccagaagcagcagccaacattctgagg

SEQ ID NO: 336275 - DNA, 492 bp, Homo sapiens
ataaagtgtttctcatctctcatgtgttttgcctgttgtgtgtaatgagcggtttcgctgtgggtgctcctttcatttctggctaacacattagagtgtgtttatgtaaattgctgtgatactggtcagcagtcacagccagaaaacataaaacatgtgggcattacacactgacacattagctctttctaaagaagaacatgtcccattctgaaaagaaaattattgctttgtttttgatattgagtctgtattaaaattttttttttatttttgagacagggtctcactctgttgcccaggctggagtgcagtggtgtgatcatagctcactgcagccttgaactctgggactcaagagttcctcctgcctcagcctcttgagtagctgggactacaggcacatgccaccatgcccagctaatttttctgttttttgtagagacaggatttcgctgtggtgctcaggctggtctccaactcctgggctca

SEQ ID NO: 336276 - DNA, 379 bp, Homo sapiens
caatttccttctttgctttccctgagcccagcccccttcactctgaagagagccaggtgtggggcactagtgaacaggccacacagtgcccccagcacacctcaacacagcggcattgttaaggcatttggactctctgagacagatggaactgtagctaccagttgttggtctgtggtctctatttggattctgaagataggtctggtaattaagatgtggcctttcaatagtttacctggaaacattctctacatgcatagagagaagttcagggatgctggctcaaccacaagagccagagacccttctgggactatagtgaatatccctggagagaccaatcaggaatttcctggaggtgagggtacaggactgg

SEQ ID NO: 336277 - DNA, 467 bp, Homo sapiens
agtgagtaaagtaggaccagttttaaacaagcattagtgtgttttgctaggtggaggctctgactataatttcatcactttaaagtgacattacttcagtgaattgaaactggcagagatattttactgattcttatttggatgtaaaaaacagcagtgcacttgaattttaaactcagattactttttagagaaagcacaagagttcttaactcttgcaggcttttgaaagcccttcttttcaggaatacttgcaattttgatcctttcagttggtaaaaatacattgcacactcattaggttggttggaaataagttgcagcttactgaagatgttattaaagtagagaactgttttgaactttggtagcgtaaaactgtaaatattatattagcaaatgtggcttatcgaagtaccagtgtgaaataatgacattttaaagttgatgccctgaggatgtcagtg

SEQ ID NO: 336278 - DNA, 111 bp, Homo sapiens
tgtgtgtgtgtgagtgtgtgtgtgtgtgtgtgtgtcacaagagcttggggcaggaatagggctgtacgacacagtggggcaggagcaggaacctgggtcctgtgtctgtgc

SEQ ID NO: 336279 - DNA, 757 bp, Homo sapiens
  misc_feature (68)..(68): n is a, c, g, or t
  misc_feature (70)..(70): n is a, c, g, or t
  misc_feature (83)..(83): n is a, c, g, or t
  misc_feature (93)..(93): n is a, c, g, or t
  misc_feature (124)..(124): n is a, c, g, or t
  misc_feature (131)..(131): n is a, c, g, or t
  misc_feature (159)..(159): n is a, c, g, or t
  misc_feature (213)..(213): n is a, c, g, or t
  misc_feature (217)..(217): n is a, c, g, or t
actgctttatgatctggtgctcctgttattggggcaaaaatatttagattagttagctcttcttgtgnantgatcccttaccnttatgtatgnccttcttttgtctcttctgatctttgttggnttaaagnctgttttatcagagactaggattttgcnacccctgcctttttttgttttccatttgcttggtagatcttcctccatcccttnattntaagcctatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgatagtctttacaatatattttgaaggtgcagattatgaaagtcaccttctgcgtgagaacacagagctggcaagtattttgagggtaccatgaagtgaaatggatccttaggacttgaagatgtgatgcagatttgtttctttcttacactgaagattggtgtgatggcagagttttaaaatcactgttaaatactgatattcagaaattttcaagccataattcatatatatgtattttttcctcccaagccatgtctattacagttttgtctgtaagcagtggtgctttttaaaataaagaacacttatacccatggtt

SEQ ID NO: 336280 - DNA, 7733 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagggagaaggaatcactttgcctactacaactatcacacttacgaagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctacgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggactgctatgccagcaatctctgttctagatttgttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatga

SEQ ID NO: 336281 - DNA, 6878 bp, Homo sapiens
ctcatgacttgcgtccgatgcagcgtggaacattgagacagtcctgtctatgtcgaaatcccagtttccctacaagacgttccggtcgtctacaaccgatccggcagactgcgctgtggccgcagcccgtcagaagtctggttcgtaactggaaaacccttgcggttactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagggagaaggaatcactttgcctactacaactatcacacttacgaagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctacgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggactgctatgccagcaatctctgttctagatttgttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatga

SEQ ID NO: 336282 - DNA, 7900 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccaggaagtgtgttctgtctacagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctacgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggtcaggataagtactccagcacaagaaagtctcatggggaccttcttcctgcccctcttaaaccacggccacccccctgccagccacgcccggcctccgatggcgtctttctctccaactcattccagccaccctcagccaaagccaacagtactgctcacaaaaaaggccagcccctgccccctccaaaaaaatccagctcctaccatcccagccactgcaaaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatga

SEQ ID NO: 336283 - DNA, 7755 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctacgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggtcaggataagtactccagcacaagaaagtctcatggggaccttcttcctgcccctcttaaaccacggccacccccctgccagccacgcccggcctccgatggcgtctttctctccaactcattccagccaccctcagccaaagccaacagtactgctcacaaaaaaggccagcccctgccccctccaaaaaaatccagctcctaccatcccagccactgcaaaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatga

SEQ ID NO: 336284 - DNA, 4503 bp, Homo sapiens
aatcggtctctgggctgggataccatgtgaaccttctgacctggagcccacacttttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggtcaggataagtactccagcacaagaaagtctcatggggaccttcttcctgcccctcttaaaccacggccacccccctgccagccacgcccggcctccgatggcgtctttctctccaactcattccagccaccctcagccaaagccaacagtactgctcacaaaaaaggccagcccctgccccctccaaaaaaatccagctcctaccatcccagccactgcaaaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatga

SEQ ID NO: 336285 - DNA, 4290 bp, Homo sapiens
ttaaattttagtcgagacagagactatgttacccaggctggtctcgaactcctgggctcaagcagtccacccacctcagcctcccaaagtgctgggattataggcgtgagccaccacgcttggccgcttttccttctttacacagataaatgcactgttactccacattagccaatgagccttgtagggcagtctcagtctctttctgtacactgatttaacagtttttcttctgtctgaagataaaatgtttgtggatatttggtaatttctagtaaatggctgaaatataataattctttttctttttgcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggtcaggataagtactccagcacaagaaagtctcatggggaccttcttcctgcccctcttaaaccacggccacccccctgccagccacgcccggcctccgatggcgtctttctctccaactcattccagccaccctcagccaaagccaacagtactgctcacaaaaaaggccagcccctgccccctccaaaaaaatccagctcctaccatcccagccactgcaaaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatga

SEQ ID NO: 336286 - DNA, 2567 bp, Homo sapiens
gtatcatggcatagctgttcctgagtatccctagagatacatgatatcgtagtcactgacagtatcgaagagccgagccgcgctgcgaatcatgcactggtcgtccgattgctgtctctctgctgccaactcgagttcctagcgatacctcagccaaagccaacagtactgctcacaaaaaaggccagcccctgccccctccaaaaaaatccagctcctaccatcccagccactgcaaaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatga

SEQ ID NO: 336287 - DNA, 2543 bp, Homo sapiens
atgttacactcacccagagttgctgtgccagtcagaggcagagctgggccagtgggcagtattcctccctcatagtgaagggcgtcaggtcaacattttagcaccttttgagagtagtaattggattactcaggccaccaacagggatgaatttcaaactgatgaaactttgatacaatatgaggggtcttttaccttcctacttactcagtaaaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatga

SEQ ID NO: 336288 - DNA, 2638 bp, Homo sapiens
atgttacactcacccagagttgctgtgccagtcagaggcagagctgggccagtgggcagtattcctccctcatagtgaagggcgtcaggtcaacattttagcaccttttgagagtagtaattggattactcaggccaccaacagggatgaatttcaaactgatgaaactttgatacaatatgaggggtcttttaccttcctacttactcagtaaaggtatttttgtattctctgagcactgcatctttatcatgagtaaagcttagaaataatcaggtactttaacttgtactgtttctttcatggaaaaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatga

SEQ ID NO: 336289 - DNA, 7820 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctacgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggtcaggataagtactccagcacaagaaagtctcatggggaccttcttcctgcccctcttaaaccacggccacccccctgccagccacgcccggcctccgatggcgtctttctctccaactcattccagccaccctcagccaaagccaacagtactgctcacaaaaaaggccagcccctgccccctccaaaaaaatccagctcctaccatcccagccactgcaaaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatga

SEQ ID NO: 336290 - DNA, 5937 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctacgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggtcaggataagtactccagcacaagaaagtctcatggggaccttcttcctgcccctcttaaaccacggccacccccctgccagccacgcccggcctccgatggcgtctttctctccaactcattccagccaccctcagccaaagccaacagtactgctcacaaaaaaggccagcccctgccccctccaaaaaaatccagctcctaccatcccagccactgcaaaggtagaggtaaaagagtgacaaatcagctctctttgtcttaatgattggaacctcagcatcactctgcacacttgccctgtagtatggtccatggcgatcatacttgccttggaatttggatgtcatgtgatcactggtctcggcatggtgatcctcctctgcctctgattgtgatgttctgtgctattactctttggtagatatcttagtactccgatttcttttacactttaaaaagttccatttctttgatcagctgacaatcagtccttctctgttgttcccaaatcacttgaagtactgttggtcttggctttcattttctctctctaccaatgatcttctatttgtttgaacaagtgcttttcacacgctgtagtgtct

SEQ ID NO: 336291 - DNA, 5261 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctacgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggactgctatgccagcaatctctgttctagatttggtatgttcttgtttctttccctttggtacttttttcctgtcttgattttcttttctttcagtggtggctgtttgatgttttcagtagatccagttctccttaggggtgtcctccatcaggagatggagtccctgacactttagaagcatgcctttgaatgttcctagatttagttactctttgcttttctccgttaattttaagtgttactgtttgtttatggttttgaccttttctcggtttcagtcataaattgattccgtgtattcttacgtagtcataaatacatgagcaaatgaaataaattttgtaatgagtaatc

SEQ ID NO: 336292 - DNA, 3337 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggcaagtattttgagggtaccatgaagtgaaatggatccttaggacttgaagatgtgatgcagatttgtttctttcttacactgaagattggtgtgatggcagagttttaaaatcactgttaaatactgatattcagaaattttcaagccataattcatatatatgtattttttcctcccaagccatgtctattacagttttgtctgtaagcagtggtgctttttaaaataaagaacacttatacccatggtt

SEQ ID NO: 336293 - DNA, 2849 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccaggtacgttccagccggccagccatgctcctccagtgattgtggttgtaattgctaagccagtgaattcagcttctttaaggcttctcatttggttacaagatttttttctaaaataaaagttatgtaaatattgtaggaaaatgtataactttaaagagttgaaaggaaatgcaagcttttttctattttgttttccctgtaaaacttcagcataagtgaagttaacttgtagtaatagttgtgagaaagtgctgagactgttgtgggcttttgtagaattttttctgtaaataatttgttgagatgaagttcatataatattaaccattttgaagtgaacaattcagtcgcatttggtgcattcacagtgttgtgcagccaccacccctgtcggttccaaaacgtctccatcacctcagagcgatacccctcaagtagttcctggggtttttcttttcccccgttccctggtaacgccttcttagactttttaaaaatggttctcaaaagtcacttgctcctgtgtaatgagcctagacgttggtagtaattgggctttttgatagcacatgtgtaggtgtaatggacattgtaacatacttctcacttaaaatgaaattctgtcataaacctgttttcaaaatttcagaagataaaggtattttgttggtagaatggtttgactcctttacgtactttctgtcccgatctacgaatt

SEQ ID NO: 336294 - DNA, 691 bp, Homo sapiens
  misc_feature (645)..(645): n is a, c, g, or t
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggaggtcagtgtatacaggaagggtttgctagaggcatgacctgacctgtgaagagacagcttgtccagggtcattgtggtcatgtcaggtttactgctcgtctccatctttcttctcttttggtgggtaggagagtagctggcaggctgagaaaactgttttatgtctgggaagtgttcttataaatccctggcaacgtgactcnttgaggtcttatttcagactgcctgaggctgtctagctagataccg

SEQ ID NO: 336295 - DNA, 539 bp, Homo sapiens
  misc_feature (493)..(493): n is a, c, g, or t
aaaaaagtgaacagacttcctcatttattattacaaaaagtgaatccttttcagaatgttgttttccaaaaatgtaccattttgttttcttttaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggaggtcagtgtatacaggaagggtttgctagaggcatgacctgacctgtgaagagacagcttgtccagggtcattgtggtcatgtcaggtttactgctcgtctccatctttcttctcttttggtgggtaggagagtagctggcaggctgagaaaactgttttatgtctgggaagtgttcttataaatccctggcaacgtgactcnttgaggtcttatttcagactgcctgaggctgtctagctagataccg

SEQ ID NO: 336296 - DNA, 524 bp, Homo sapiens
caaatggataattttaaatgtctggtaattcagtttgcagaggggattaaaggtgtagagtaagaagaatcaataccgtgtgttggatattaagcaattggtaattaatcttgcttcctttatcttgacaagatgtgctttttcacttacaatttgcttgtttcctccttaggattttgcaggttaattcctcacacacgttcaccaggtacttggacaatatattttgaaggtgcagattatgaaagtcaccttctgcgtgagaacacagagctggcaagtattttgagggtaccatgaagtgaaatggatccttaggacttgaagatgtgatgcagatttgtttctttcttacactgaagattggtgtgatggcagagttttaaaatcactgttaaatactgatattcagaaattttcaagccataattcatatatatgtattttttcctcccaagccatgtctattacagttttgtctgtaagcagtggtgctttttaaaataaagaacacttatacccat

SEQ ID NO: 336297 - DNA, 395 bp, Homo sapiens
ttctaaacccgttgtgctttctctccatgtagagcaccactaggctggacagcgacagagtgtcgtctgcctctagcacagccgagcggggaatggtgaagccgatgatcagagtagaacagcagccagattatcgcaggcaagaaagcaggtaggaaacacatcatttttcaatggtgaaagtactgaaagtattcctaaaaaagggttgggataaagattgttgaatttataaaggttcagctgacatgtttacaatgttagcaataatattttaagggcatttcctttctgtgttattgaattgaaagaaatgctttaccaataattatatccctcacttatatgccacagtgttatcagattgaaataagagtacattgaattaaaatgtt

SEQ ID NO: 336298 - DNA, 4981 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctacgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgagggtaaaggggggagtgctttggctgtgcccatctgtggtccctattttagcttctgcgtgtttcccatggggatag

SEQ ID NO: 336299 - DNA, 7700 bp, Homo sapiens
cccaaccccaggcctcctgaaccggcccaaccccttgctggcgttgccccccgtccgcccccacggcccacaggacaaggaccaggcagtggagagcgcccaagcggaggattactcgcagctgcccggagaagatcacatcctgtagcacctgcccgcccggctcaatgagggtgcgcacctgagggacgggaggcgaggaggcgaggcaggatggaaagagagagaggagagagacagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagggagaaggaatcactttgcctactacaactatcacacttacgaagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctacgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggactgctatgccagcaatctctgttctagatttgttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatga

SEQ ID NO: 336300 - DNA, 7880 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctacgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggtcaggataagtactccagcacaagaaagtctcatggggaccttcttcctgcccctcttaaaccacggccacccccctgccagccacgcccggcctccgatggcgtctttctctccaactcattccagccaccctcagccaaagccaacagtactgctcacaaaaaaggccagcccctgccccctccaaaaaaatccagctcctaccatcccagccactgcaaaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatga

SEQ ID NO: 336301 - DNA, 4860 bp, Homo sapiens
gcggccgccagagcgaaggctcacgtcacatgacggctgctcagaacgatgacgctgggcgattaaaagttcagatatttttctacaaagtcagggaaacatatatatctttattgattttttttttaaagatactttaaaaatggttagatttgttgcttaaaatagtgaagtttcagttaatgagaaaataagctttgaaagtgtttatcttcccatcattactaattaagtaaaaatattttctttattctcagtatatttacttaaaagctgttttatgattctgtaggaagaattgacctttatcaccttatttcttatgctaagaacaattcttatggaattttaatgataatcagggtgttgaaaataaaatcttaagagatactgaatatgctttgattccagtttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggtcaggataagtactccagcacaagaaagtctcatggggaccttcttcctgcccctcttaaaccacggccacccccctgccagccacgcccggcctccgatggcgtctttctctccaactcattccagccaccctcagccaaagccaacagtactgctcacaaaaaaggccagcccctgccccctccaaaaaaatccagctcctaccatcccagccactgcaaaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatga

SEQ ID NO: 336302 - DNA, 8194 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctacgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggtcaggataagtactccagcacaagaaagtctcatggggaccttcttcctgcccctcttaaaccacggccacccccctgccagccacgcccggcctccgatggcgtctttctctccaactcattccagccaccctcagccaaagccaacagtactgctcacaaaaaaggccagcccctgccccctccaaaaaaatccagctcctaccatcccagccactgcaaaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatgaaaaaaaaacagccaccactaaacaccaaaaaacaacaaaaaaaaaagggaggggcgaaaaatatcccggggaggggcacagaattaagcgccacccacatctatgtgtaaaaggcgcccccaagagagagcgacatctaatagagcaacaggcggcgccttataaagcgctgccgaggcaacaagtcgcgtaggattgtgagagaaccgcttcgtcgtggggatagttggaaccaacagattgatgcgagagaaatacaatatggtggacgtgggtcaaccaacgttcgggattcgtgacaataagtagatcac

SEQ ID NO: 336303 - DNA, 3272 bp, Homo sapiens
gaattgtgcttgttgaatgtgtgaatgtagatgataaattccatcttatagccatgattaatggaggaataactgggatttgtggcaaccgtttttaggtaatttattttaaaattgtagagctaaaaaattgtaaaaagttttattttccaacagtgattttaacctggtattttatatttaactttctgtgtgtgtgtgtttgtgtatatgtgtgtctacttgtcttaatgtgtgcattttatgtcttgtgctggtggagtttgtggagggagattaatgtcagcctgttgttagtttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggtcaggataagtactccagcacaagaaagtctcatggggaccttcttcctgcccctcttaaaccacggccacccccctgccagccacgcccggcctccgatggcgtctttctctccaactcattccagccaccctcagccaaagccaacagtactgctcacaaaaaaggccagcccctgccccctccaaaaaaatccagctcctaccatcccagccactgcaaaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatga

SEQ ID NO: 336304 - DNA, 6424 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctacgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggtcaggataagtactccagcacaagaaagtctcatggggaccttcttcctgcccctcttaaaccacggccacccccctgccagccacgcccggcctccgatggcgtctttctctccaactcattccagccaccctcagccaaagccaacagtactgctcacaaaaaaggccagcccctgccccctccaaaaaaatccagctcctaccatcccagccactgcaaaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctcggacgtgcgtcatcacacaggaagctttggcctaagccacttcacgatgcagactagaaggtcgacgcgg

SEQ ID NO: 336305 - DNA, 5165 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctacgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaaggttatggtcctttaagggcagctagaattttaccaagttagcctgaacgtaatcgattggctggggcagagcgggctggaagttctgtgtttcttaagaagcacgaggcagagcagggcctggc

SEQ ID NO: 336306 - DNA, 2804 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccaggtacgttccagccggccagccatgctcctccagtgattgtggttgtaattgctaagccagtgaattcagcttctttaaggcttctcatttggttacaagatttttttctaaaataaaagttatgtaaatattgtaggaaaatgtataactttaaagagttgaaaggaaatgcaagcttttttctattttgttttccctgtaaaacttcagcataagtgaagttaacttgtagtaatagttgtgagaaagtgctgagactgttgtgggcttttgtagaattttttctgtaaataatttgttgagatgaagttcatataatattaaccattttgaagtgaacaattcagtcgcatttggtgcattcacagtgttgtgcagccaccacccctgtcggttccaaaacgtctccatcacctcagagcgatacccctcaagtagttcctggggtttttcttttcccccgttccctggtaacgccttcttagactttttaaaaatggttctcaaaagtcacttgctcctgtgtaatgagcctagacgttggtagtaattgggctttttgatagcacatgtgtaggtgtaatggacattgtaacatacttctcacttaaaatgaaattctgtcataaacctgttttcaaaatttcagaagataaaggtattttgttggtag

SEQ ID NO: 336307 - DNA, 1784 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctgggtaaatagattaaccctaagatttaaaatgttttgattatacttaaagtagttcagattattcatagatatcttggctttttatttttgtttcaatttttaaaaaaatat

SEQ ID NO: 336308 - DNA, 556 bp, Homo sapiens
ctgagctatgattttgtaagatacaaccaaaatggagactagaaggagattgtgcaaggatggttctgccctaaactgtctgagaaagggagagaaatgcttccaccagcaggcacagcacttgtgggaataaacgggaaggttcgtgcttgtgctgagtgcggtctggggagtaatagacattttcacgagaggctgcaggatggggagagacacttcaggccagagttgggcagagcttatcctggcttaactgggggcaggaggtgtccagaagcatagggaggtttttgtcaactaaggaacagtgctgatgcggcaagaacgggaacagggcagggcatggaacccagagggaagacgggggtgatccccgacttcaggtggagtgacagtgggcaggcagtcgcagtcctgtcaaggccaagggtatttggaggggcctgtggttctgtagtctcccactgtctacctaggaggtggctgtaacctagccctgggggtagagaaaggaactttaggggggcttctccatagaggtcaggagaggaagggg

SEQ ID NO: 336309 - DNA, 1230 bp, Homo sapiens
tgctggatttcagacttgcatgggtcctgtagcccctttgttttggccaatttctcccatttggaatggctatatttacccaatgcttataccaccattctatctaggaagtaaataacttgcttttgattttacaggctcataggcagaagggatttgccttgtctcagatgagactttggactgcggacttttgagttaatgctgaaatgagttaagacttcggaggactattgggaaggcatgattggttttgaaatgtgaggacatgagatttgggaggggccaggggtggaaggatacggttgggttctgtgtccccacccaagtcttatcttgtagctcccataacccatgtgtcttgggagggacctggtaattcaatcatgtgggctggatgcggttgctcatgcctgtaatcccagcactttgggaggccaagggggagatcacttgcgatcaggagtttgagaccagcctggccaacatggtgaaaccccatctatactaaaaatacaaaaattagccaggcacggtggtgggcacctgtaatcccagctacttgggaggctgaggcatgagaatcacttgaacctggagtgcagtggcgcgatctcggctcactgcaagctccgcctcccaggttcacgccattctcctgcctcagcctcccgtgtagcaggcattgtcacaggcgcctgccaccacacccacctaatttttttgtatttttagtagagacggggtttcaccgtgttagccagggtggtatcgatctcctgaccttgtgatccgcccaccttgggctcccaaagtgttgagattacaggcgtaagccactgcacccggcaataaacctctttcttttgtaaattgcccaggtatgtctttatcagcagcatgaaaatggactcatacaatgatccattacctagggtaaaattctcctgaatgtcaaacaaagagataaactacatttgggttttgggaagtcccctgtaatgatgaatcaagaatcctcaagtctgtcttgccacccatttaatacgtatttttgttaaggctgaagtttagagttagaatcaggacattttggcctattgagaggttctgaattccaacagaagatgccatgtaaatcagtgaatttgattcttttaaaagcaacttacaaaatttacaagatgtattcaataaagcagtttagctttggtatatcaaaccttataa

SEQ ID NO: 336310 - DNA, 425 bp, Homo sapiens
caccacatccatagctctagcccagattgctccacccagctgcctgctagaaacctctacttggctgcctctcaggcagctcaagggagatgtgcccttttcttttaacccacccttccattggcctccctacctcagataatacactgctagctacctagctgcccaaggcacaatcctagccatcacctttgtcccctcaccaagtcctgtcaattctactgcctaaatatttcccaaatctgtccttttctttccattccctgctgccaccaacctggttcaggctaaggtcatatctagactggacaactgtggcagcctcctgactggcctccctgcgtccactcccatcccccgctaactcattctccacgctgggaccagagtaatgtaatgcctgttgctcgggataatgtacacag

SEQ ID NO: 336311 - DNA, 309 bp, Homo sapiens
ctttgtattccagcctgggtgacagagtgagaccctgtctctaaggggttttgcatggttatccagagcagtctcttgaattttggttgtctttgacgcagctgcatctggagatcctctatgtgaggcatgtttagagaaagagaaacattgacccctggaattgatattcttccaagaaatcttttagtcttgttggtaaaggcagtcctcagatggtaccggtccctttgttagtggtgagcctacagagatggtgcctggtgtgcagagcgatgtggttggatggaggtgaacagagcagtctag

SEQ ID NO: 336312 - DNA, 1583 bp, Homo sapiens
ctcagatgagtgtggccgtatttgtgttactcaagctgctttgtcatctgcatttgaagaaacgtggtgagcctcctgtgtgtgcccatgtggcagtgggcacctctgccccctgcaaaggctgtctaagaacacagagcctgcagtacaggccctgcctcctgacatgccccaggccggctggaagaaagcgcgggactgtcctattgacgtggggaggggacggctggactctgtgatgctaactgtgttctctgctgggccatgtggctccccacagagaccctgggtgcccagtcattcgcgttctcctatgtgtgtgtatatatattatatatacatgtatttactaactttagaaagcccccaagggggccttgtttctgcttggacagtcagcgtccatagcgtgtcattcctaagctccattaaggagattcagaagcaagcagttacccctggagtctgcacgctgggcacaagggtcacaccttcgttgagagctcctgaccccaggagccgagggcaggacacggtagtgtttacaggacctggcaaaggggcactgccttgtgtgtgaggttttttcaccagtcagtcccttttaaaaacagcatatcttttgaagaacaagaagtttacgcaggcataagcaactcactttgcacgtggagctttcaggacgtttcatgtctgttacgttatagcctctatcctcatgggggctctgagttcagcagggcctgagctgttaatctgctttttcaaattattaataatgaaagtaacaccatgccaccacctggtatcatttcatgctttctatgtgcctggtgtttacacggcttatctcatttaatcttcccagcatgtaataaaaatattgcaacaggtactgctcctgtgtggactccttcccccgagctcacactgcttgaggccttcccagctctgggctttgtgtcctgtgtggacttcttccccgagctcacactgcttgaggcattctagctctgggctttgtgaatatcctgcttttatcctcatttataggtaagaaagctgactcagagaggttaagcagctggtctgaggtcaactgcttacgggtcggggagctgggcctgcacacaggggtctgatgcagagctggtcctatctgctttataagctgtggctcacagggcactccaggggctcgagaggacctggcgggctgagatgaagactggtgaggcctgggaggcaggtgcttgactgaggtgggaagtgggaccttggtgccaagcattcccagggccacggggcaggcctgtagggtctggtgggtatctggggtcccggagaagcccttggcacggggcttcatgagagcataggcgagtgccgcgccctgcagttgagcacgggggatgcagctgtcgcagtcgcttttgaagagtgaggggtgaggcctgcagttgctgcccgacgttgtttacaagtgagcaagttttacaaaaaacatggacagcatcagggctgacttgaattttttacttgaggcagcagctcaacctgttggtttcctcaattgtgaatta

SEQ ID NO: 336313 - DNA, 168 bp, Homo sapiens
tgtcactttgcctagaaattcattcttctataatctcgttttaaagtaggatatgtaaaataggacatggagctgtttatgaaagaggaggactgaaggtgaagaatctgaacctgacttctcactcatggctgtacattacaagttttctatcaacacagaactatc

SEQ ID NO: 336314 - DNA, 450 bp, Homo sapiens
tgggagaagggagagctggaaagctgttgtcttctcttcttcccattcagcagaccatagaatacttcagggtctctgccacatagagatgccaaaaagcttggatgatggctcaaccattcagtttttattaaggacacaactttgccaagagctctaagcttcatcaatttctttgacatctaggttcctaccatgttcttacctactccactacttgacctgctgattcatttatttgtgccaggcactttacataccttacttctaatcttcccacctcacctgtatttctccgcagcgtttagcacaaatatgatgaattgaccattgatgtgattatttgtttttatttgtgaactctgcgagttcaggagccatgtcagtcaccattgtacccctgtgcctggtggttaacaaatattgatcaacaaactggaggatataatt

SEQ ID NO: 336315 - DNA, 365 bp, Homo sapiens
tcaatttgttcctctcatcagaaatgctctttcccctctgagtcatcagtgcaaatcctacagtcctccaggctcaggtgaaatgccacctcccatgcccagttgccctgactctccattcttctaggaactcctccagcagcccggcatctgattctatcgaatcctgcactgcttacctcatttcatacgtacacttttgaggataaggctcatagcttacagatctttttcaaatccagtcagatttaggacagtgccttgggcagtcatttgctgattgattctaaagtcaactctctccaacagtaggtgtctatgccactatcaggcagtatttctcaaagcgtggccaataaccacct

SEQ ID NO: 336316 - DNA, 143 bp, Homo sapiens
cactaaagatctttacctgaagaaaaaaaggaaaaaagaatgaccacttaatatgatatacagcattttctaaaataacaagaacaccaaaaaccccatttaattcttcttcttcttcttttttttttttttttttttttttg

SEQ ID NO: 336317 - DNA, 157 bp, Homo sapiens
gtctccaaaatttatgcatctagatgtgaccttcctccaggctgcaagcaattgcaactgcatactggcctctcttcctgaatgaacatgctgtaagccactcaacctcaaaatctacaagggtgagttcacccgcttcaccacttcccctcctgtt

SEQ ID NO: 336318 - DNA, 583 bp, Homo sapiens
atgagacgctcatcttgatttattcatcctcaggcaaacttgatctggagcatacaataaatattgtgatacctacgtgaattaaaacaatcacttacttattagcgcttggcaccagaaatacagtcaggattaatgtcttgggattcctgcctctccttctaatcttatctattttacaagtaagctctttgccttctgagttcattgtaggaattgcagttttacatcaattacatttccattagcattgtagatatcccttttcatataacattatcaggctgcagatacacaaaatgtcaatattttccctcacttcattatgctaatcacactctgagctccagtgccgggtccgtccaggagtcagatgtttgcgctgatgcaacatttacaagcagctgatcttcccaggcagccgcctccctcatttgcagatgcagacgagggctaatgggccagagtaaagcatgtgtctgctgtggtgaccttctaaccatgccggcaccccgagatctgtcacgcagctgcaggggccacgccgctccccgcagtctccttcaccggctccttctccaca

SEQ ID NO: 336319 - DNA, 557 bp, Homo sapiens
acagagttttgctcttattgcccaggctggagtgcaatggcacgatctcagctcactgcaacgtctgcctcccaggttcaagcgattctcctgcctcagcctcccgagtagctgggattacagggcctactgcagtgcatgaaggtggtatggactcagaactctgaagtctgaggagacaaatacatgcccaccataacaacatcacacaatacctagagtcaaaacagttatccctattcctacccccaactgagttattcaataaagcctgccttgttgaatctgttttcccatgtatagtttatatagttacataacaattagttttttccatatacttaggataactacatgtaatttagtattctgctgttttcacttacatatcacatacattttcctgatacaggtacatagtctttatatttgtcatttttcacttgactgctatgtttctcaaattgatatactgtcatttcctaagccagttatatattgttgaacatttaaattactcccttttttggtttgtaaataaacattgttatgaaata

SEQ ID NO: 336320 - DNA, 552 bp, Homo sapiens
cccaacacttttgggaggcaaagcgcgtggatcacaaggtcaagagatcgagaccatcctggccaacatggtgaaaccctgtctctactaaaaatacaaaaattagctgggattacagggcctactgcagtgcatgaaggtggtatggactcagaactctgaagtctgaggagacaaatacatgcccaccataacaacatcacacaatacctagagtcaaaacagttatccctattcctacccccaactgagttattcaataaagcctgccttgttgaatctgttttcccatgtatagtttatatagttacataacaattagttttttccatatacttaggataactacatgtaatttagtattctgctgttttcacttacatatcacatacattttcctgatacaggtacatagtctttatatttgtcatttttcacttgactgctatgtttctcaaattgatatactgtcatttcctaagccagttatatattgttgaacatttaaattactcccttttttggtttgtaaataaacattgttatgaaata

SEQ ID NO: 336321 - DNA, 334 bp, Homo sapiens
aaatgaaagaaaaagcacattgcaaccaaagaggcaaacaatgaaaaatagaaaacatgaggaaagaattaatgatgagaaaaataaccataatggaaaactgttccctacttcctattgactttcttatgtgttggttttgaaatatcagtagccattctattttgcctgtataggtacatgtttgtttcgtgcaaccatacaactttcattttagtaatttctaatgtcctctctctcctttagcctttccatgatacagattgcacctacttagaaccatttcaatatatgtagctatacattaaatatctaaaacttttttccaaaacca

SEQ ID NO: 336322 - DNA, 417 bp, Homo sapiens
catgaaaacattgtgaggaagagaaataaatcttgccataaatgtgccttgtgtatcatttggaataatagatgcagtgacacctcacaaggggttttacaaccagtgattaatatctactccaatatatttctgctttataatacacttgggcattcttgtttgggaaaattgcctactcaccatgtaggaaaagaacattttcttcccgattgcaatgtaattgctaaaaatcaatctcagaatcaagagataaaacctccaaaattctttaactgctcctgctgtttctgggctatgtggcaggtacatatttctattcatatggtatgactgagtgaaggctgtaagtcctgaacatccaaaggtaaaatgtaaatatagaatcaagcaaaaaattttgcagtaagcagagaa

SEQ ID NO: 336323 - DNA, 301 bp, Homo sapiens
atggtgtttgtttctcgtttttggctactgtgagtaaagctgctttgaacattcttggacaggtctcttaatggatatatgcactgatttctcttggaaatatacctaggagtgggattgctgggtttgccaactatttctccaaactggccgtactggtttatagtctctccagcagtgtgggacagttagtccacgttctaaccaacacttggcattgtcctcttgattttaagcctcctggtgggtatcaattgatgttttactttgcatttctaagtaagaactttcctgactaaat

SEQ ID NO: 336324 - DNA, 6942 bp, Homo sapiens
actcactatagggctcgagcggccgcccgggcaggtcagaattttgatttggctgctgggctgctaccttgaaatccaagccctaaaaatgccagcttctttggacttagaagatgacctggataaatgataaaaattaagaaagagattttgaagttttcttattgtcctcttggcatatgcttctggaataatattcaccatggttttggatgaccttccaaacttagaagacatctatacttccttgtgttcatcaacaatggaagactcagagatggattttgactctggactagaagatgatgacacaaaaagtgatagtattttggaggattccacaatttttgtggccttcaaaggaaatatagatgataaagacttcaaatggaaattagatgcaatattgaaaaacgtgcccaatttgttacacatggagtccagcaagctaaaagtacagaaggtggagccctggaacagcgtgcgtgtgacattcaacatcccccgggaagcagcggagcggctacggatccttgctcagagcaacaaccagcagcttcgggatttagggattctctccgttcagattgaaggggaaggtgctattaacctggctttggctcagaaccgaagccaagatgtgagaatgaatggacccatgggagctggaaattcagttaggatggaggcgggatttcctatggcaagtggtccaggaataataaggatgaacaaccctgccactgttatgatacccccgggtggaaatgtgtcatcttccatgatggcaccaggccccaatccagagctgcagcccaggactcctcgccctgcttctcagtcagatgcaatggatccactcctctctgggctccatatacagcagcaaagtcatccctcaggatctttagctcccccacatcacccaatgcagcctgtctctgtgaacagacaaatgaacccagctaattttccccagctgcagcagcagcagcaacaacaacaacagcagcagcagcagcagcagcagcaacaacagcaacagcagcaacaacagttgcaggcaagacccccacagcaacatcagcagcaacagccacagggaattcgaccccagtttactgccccaactcaggtgcctgttcctccaggctggaaccagctgccttctggagcccttcaacctcctccagcccagggttctctgggcacaatgactgcaaaccaagggtggaagaaggctcccttgcccggcccaatgcaacagcaactccaggcaagaccatccttagccacggtacagacgccttcccaccctccccctccatatccctttggcagccagcaagcctcacaagcccacacaaactttcctcagatgagcaacccaggccagttcacagctcctcagatgaagagtttgcagggagggccctctagggtcccaactcccttgcagcagccccacctcaccaacaagtctcctgcctcctcaccctcctccttccagcagggatcccctgcatcctccccaacggttaaccaaactcagcagcagatgggaccaaggccacctcaaaataacccacttccccagggatttcagcagcctgtcagctctccgggtcggaatcctatggttcaacagggaaatgtgccacctaacttcatggtgatgcagcagcaaccaccaaaccaggggccacagagtttacatccaggcctaggaggaatgcctaaacgcctcccacctggcttctcagcaggacaggccaatccgaactttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcagaaccagtccaatgtcatgccgggaccagcccagataatgaggggaccaactccgaacatgcaaggaaatatggtgcagtttacgggacagatgtcaggacagatgctgccccagcaagggcctgtgaacaacagtccatctcaggttatgggcattcagggacaggtcctgcggccaccagggcccagcccacacatggcccagcagcatggtgatcctgctactacagcaaataacgatgtcagtttatctcagatgatgcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaacaccccagatactcgcccagctggtctggaagaggctgatcagccaccgttgcctggagaacaaggaattaacttggataactcaggccctaaactgccagaattttcaaaccggccaccaggttatccttctcaaccagttgaacagaggccacttcagcagatgcctcctcaactcatgcagcatgtggcacccccaccacagccaccacagcagcagccacagccacaactgcctcagcagcagcagccaccacctcccagtcagccacagtctcagcagcagcagcagcagcagcaacaaatgatgatgatgctcatgatgcagcaggatcccaaatcagttaggcttccagtctctcaaaatgtccatcctccaaggggccccctgaaccccgactcccagagaatgcccatgcaacagagtggcagtgtgcctgtcatggtcagtctgcaaggacctgcctccgtgccaccatcacctgataaacaaagaatgccaatgcctgtgaatactcccttgggaagcaattcaaggaaaatggtctatcaggagagcccgcagaatccttccagctcgccactggcggagatggcctcactccctgaagcaagtggcagtgaagcaccatctgtcccaggaggcccaaacaacatgccttcacatgtagtacttccccagaatcagttaatgatgacagggccaaaacctggaccatcgcccctttcagcaactcaaggtgcaactccccagcaaccccctgtaaattccctgcccagctctcacggccaccacttcccaaatgtggctgcgccaacccagacatctaggcccaaaacaccaaacagagccagccccagaccctattatcctcagacacccaacaaccgccctcccagcacagaaccttcagaaatcagtctgtcaccagaaagactcaatgcctccatagcaggactcttccctccacagattaatattcctttacctcctaggccaaatttaaacaggggctttgatcaacaaggcctaaatccaacaactttgaaggccatcgggcaagcaccttcaaatcttaccatgaatccttccaattttgctaccccacaaactcacaaattagattctgtggtagtgaattctggaaagcagtctaattctggagcaacaaaacgggcaagtccaagcaacagtcgcaggtctagtcctgggtccagtaggaaaaccactccaagccctgggaggcaaaattcaaaagcccctaaacttactctggcctctcagacaaatgcagccctattgcagaatgtggagttgccgagaaatgtattggtcagtcccactcctctggccaatccccctgtacctgggagctttcctaacaacagtgggctgaatcctcagaattctactgtgtctgtggctgcagttgggggtgttgttgaggataacaaggagagcttgaatgtgcctcaggacagtgattgccagaattcccagagtaggaaggaacaggtaaacattgaactaaaagcagtccctgcccaagaagttaaaatggttgtccctgaagatcagtccaaaaaggatgggcagccttcggatcctaacaaacttcccagtgtcgaagagaacaaaaatttggtgtctcctgctatgagggaagcaccaacatcgttaagtcaacttcttgacaactctggagctcccaatgtgacaattaaaccccctgggcttacagatctggaagtaacacctccagtagtttctggggaggacctcaaaaaagcatctgtcattcccacactgcaggatctgtcttcttctaaagaaccttctaattccctaaacttacctcacagtaatgagctgtgttcatcccttgtgcatcccgaattgagtgaggtcagttctaacgttgcaccaagcatccctccagtaatgtcaagacctgttagctcttcctccatttccactcccttgcccccaaatcaaataactgtatttgtcacttccaatcccatcacaacttcagctaacacatcagcagctttgccaactcacttgcagtctgcattgatgtcaacagttgtcacaatgcccaatgcgggtagcaaggttatggtttctgagggacagtcagctgctcagtctaatgcccggcctcagttcattacacctgtctttatcaattcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtcccttctcatccccctgtgcagcaagtgaaagaattgaatccagatgaggctagccctcaggtgaacacctcagcagatcagaacactcttccctcttcacagtcaaccacaatggtttctccccttttgaccaatagtccagggtcctctggcaaccggcgaagcccagtctcgtctagtaagggcaaaggaaaagtggacaaaattggccaaattttgttgaccaaggcatgtaagaaagttacaggctctcttgagaaaggggaagaacaatatggtgcagatggagagactgaaggccaagggctagacaccacagctccggggctcatgggaacagagcagttatccacagagctggacagtaaaaccccaacgcccccagcacccactctgctaaaaatgacctctagccctgtgggcccgggcactgcctcagcaggacccagcttacctggcggtgctctccccaccagtgtacgctcgatagtaaccactctggtaccctccgagctcatctccgccgtaccgaccacaaaaagcaatcatggtggcatagcatctgagtcacttgcgggtggcctagtggaggagaaggtgggatcccatccagaacttctacccagcatagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaaacaagcaggactgcgacttgatacttggaaatgtgtgtgacttttacaaagagcaattttgagctgtgacttttttaaatcaatttctgtacagttagtaattttaataatgtggcccttttcctagtccctgcaacctgtttcataaagtgcaatggggaaagcaggactgttgagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgatgtattgtgccgtggaagtactgtgtgtgaatagcagtagtgggggcaaaagcaatcttctcatttggaaatgttgtaaataattttattatatagtgttttggatgtatttgttgtagaaatggaccagtgaataaagagaatctaaggatttgtacaatgtgaaataacgtgttaaataaatgtcattgtcatagaacataaagttatgttattggtaaggga

SEQ ID NO: 336325 - DNA, 7026 bp, Homo sapiens
agaccaagtcttgctctgtcacccaggctggagtacagtggtgccgtattggctcactgcaacctctgcctctgagttcatgtgattctcctgcctcagtctcccgagcagctgggattacagaattttgatttggctgctgggctgctaccttgaaatccaagccctaaaaatgccagcttctttggacttagaagatgacctggataaatgataaaaattaagaaagagattttgaagttttcttattgtcctcttggcatatgcttctggaataatattcaccatggttttggatgaccttccaaacttagaagacatctatacttccttgtgttcatcaacaatggaagactcagagatggattttgactctggactagaagatgatgacacaaaaagtgatagtattttggaggattccacaatttttgtggccttcaaaggaaatatagatgataaagacttcaaatggaaattagatgcaatattgaaaaacgtgcccaatttgttacacatggagtccagcaagctaaaagtacagaaggtggagccctggaacagcgtgcgtgtgacattcaacatcccccgggaagcagcggagcggctacggatccttgctcagagcaacaaccagcagcttcgggatttagggattctctccgttcagattgaaggggaaggtgctattaacctggctttggctcagaaccgaagccaagatgtgagaatgaatggacccatgggagctggaaattcagttaggatggaggcgggatttcctatggcaagtggtccaggaataataaggatgaacaaccctgccactgttatgatacccccgggtggaaatgtgtcatcttccatgatggcaccaggccccaatccagagctgcagcccaggactcctcgccctgcttctcagtcagatgcaatggatccactcctctctgggctccatatacagcagcaaagtcatccctcaggatctttagctcccccacatcacccaatgcagcctgtctctgtgaacagacaaatgaacccagctaattttccccagctgcagcagcagcagcaacaacaacaacagcagcagcagcagcagcagcagcaacaacagcaacagcagcaacaacagttgcaggcaagacccccacagcaacatcagcagcaacagccacagggaattcgaccccagtttactgccccaactcaggtgcctgttcctccaggctggaaccagctgccttctggagcccttcaacctcctccagcccagggttctctgggcacaatgactgcaaaccaagggtggaagaaggctcccttgcccggcccaatgcaacagcaactccaggcaagaccatccttagccacggtacagacgccttcccaccctccccctccatatccctttggcagccagcaagcctcacaagcccacacaaactttcctcagatgagcaacccaggccagttcacagctcctcagatgaagagtttgcagggagggccctctagggtcccaactcccttgcagcagccccacctcaccaacaagtctcctgcctcctcaccctcctccttccagcagggatcccctgcatcctccccaacggttaaccaaactcagcagcagatgggaccaaggccacctcaaaataacccacttccccagggatttcagcagcctgtcagctctccgggtcggaatcctatggttcaacagggaaatgtgccacctaacttcatggtgatgcagcagcaaccaccaaaccaggggccacagagtttacatccaggcctaggaggaatgcctaaacgcctcccacctggcttctcagcaggacaggccaatccgaactttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcagaaccagtccaatgtcatgccgggaccagcccagataatgaggggaccaactccgaacatgcaaggaaatatggtgcagtttacgggacagatgtcaggacagatgctgccccagcaagggcctgtgaacaacagtccatctcaggttatgggcattcagggacaggtcctgcggccaccagggcccagcccacacatggcccagcagcatggtgatcctgctactacagcaaataacgatgtcagtttatctcagatgatgcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaacaccccagatactcgcccagctggtctggaagaggctgatcagccaccgttgcctggagaacaaggaattaacttggataactcaggccctaaactgccagaattttcaaaccggccaccaggttatccttctcaaccagttgaacagaggccacttcagcagatgcctcctcaactcatgcagcatgtggcacccccaccacagccaccacagcagcagccacagccacaactgcctcagcagcagcagccaccacctcccagtcagccacagtctcagcagcagcagcagcagcagcaacaaatgatgatgatgctcatgatgcagcaggatcccaaatcagttaggcttccagtctctcaaaatgtccatcctccaaggggccccctgaaccccgactcccagagaatgcccatgcaacagagtggcagtgtgcctgtcatggtcagtctgcaaggacctgcctccgtgccaccatcacctgataaacaaagaatgccaatgcctgtgaatactcccttgggaagcaattcaaggaaaatggtctatcaggagagcccgcagaatccttccagctcgccactggcggagatggcctcactccctgaagcaagtggcagtgaagcaccatctgtcccaggaggcccaaacaacatgccttcacatgtagtacttccccagaatcagttaatgatgacagggccaaaacctggaccatcgcccctttcagcaactcaaggtgcaactccccagcaaccccctgtaaattccctgcccagctctcacggccaccacttcccaaatgtggctgcgccaacccagacatctaggcccaaaacaccaaacagagccagccccagaccctattatcctcagacacccaacaaccgccctcccagcacagaaccttcagaaatcagtctgtcaccagaaagactcaatgcctccatagcaggactcttccctccacagattaatattcctttacctcctaggccaaatttaaacaggggctttgatcaacaaggcctaaatccaacaactttgaaggccatcgggcaagcaccttcaaatcttaccatgaatccttccaattttgctaccccacaaactcacaaattagattctgtggtagtgaattctggaaagcagtctaattctggagcaacaaaacgggcaagtccaagcaacagtcgcaggtctagtcctgggtccagtaggaaaaccactccaagccctgggaggcaaaattcaaaagcccctaaacttactctggcctctcagacaaatgcagccctattgcagaatgtggagttgccgagaaatgtattggtcagtcccactcctctggccaatccccctgtacctgggagctttcctaacaacagtgggctgaatcctcagaattctactgtgtctgtggctgcagttgggggtgttgttgaggataacaaggagagcttgaatgtgcctcaggacagtgattgccagaattcccagagtaggaaggaacaggtaaacattgaactaaaagcagtccctgcccaagaagttaaaatggttgtccctgaagatcagtccaaaaaggatgggcagccttcggatcctaacaaacttcccagtgtcgaagagaacaaaaatttggtgtctcctgctatgagggaagcaccaacatcgttaagtcaacttcttgacaactctggagctcccaatgtgacaattaaaccccctgggcttacagatctggaagtaacacctccagtagtttctggggaggacctcaaaaaagcatctgtcattcccacactgcaggatctgtcttcttctaaagaaccttctaattccctaaacttacctcacagtaatgagctgtgttcatcccttgtgcatcccgaattgagtgaggtcagttctaacgttgcaccaagcatccctccagtaatgtcaagacctgttagctcttcctccatttccactcccttgcccccaaatcaaataactgtatttgtcacttccaatcccatcacaacttcagctaacacatcagcagctttgccaactcacttgcagtctgcattgatgtcaacagttgtcacaatgcccaatgcgggtagcaaggttatggtttctgagggacagtcagctgctcagtctaatgcccggcctcagttcattacacctgtctttatcaattcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtcccttctcatccccctgtgcagcaagtgaaagaattgaatccagatgaggctagccctcaggtgaacacctcagcagatcagaacactcttccctcttcacagtcaaccacaatggtttctccccttttgaccaatagtccagggtcctctggcaaccggcgaagcccagtctcgtctagtaagggcaaaggaaaagtggacaaaattggccaaattttgttgaccaaggcatgtaagaaagttacaggctctcttgagaaaggggaagaacaatatggtgcagatggagagactgaaggccaagggctagacaccacagctccggggctcatgggaacagagcagttatccacagagctggacagtaaaaccccaacgcccccagcacccactctgctaaaaatgacctctagccctgtgggcccgggcactgcctcagcaggacccagcttacctggcggtgctctccccaccagtgtacgctcgatagtaaccactctggtaccctccgagctcatctccgccgtaccgaccacaaaaagcaatcatggtggcatagcatctgagtcacttgcgggtggcctagtggaggagaaggtgggatcccatccagaacttctacccagcatagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaaacaagcaggactgcgacttgatacttggaaatgtgtgtgacttttacaaagagcaattttgagctgtgacttttttaaatcaatttctgtacagttagtaattttaataatgtggcccttttcctagtccctgcaacctgtttcataaagtgcaatggggaaagcaggactgttgagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgatgtattgtgccgtggaagtactgtgtgtgaatagcagtagtgggggcaaaagcaatcttctcatttggaaatgttgtaaataattttattatatagtgttttggatgtatttgttgtagaaatggaccagtgaataaagagaatctaaggatttgtacaatgtgaaataacgtgttaaataaatgtcattgtcatagaacataaagttatgttattggtaaggga

SEQ ID NO: 336326 - DNA, 5900 bp, Homo sapiens
ctgagtttgtaccactatatgaacgttcttctactgttagggtgatgcaaccataggacgagatacaagcaagacaagacttgaagggtttggaagagacagtgctccgaaaaacatgaaaatacacaggattgggaaatattatgtgggttctctctaccatgattatactaaatataaagtctgagctccaaaaatatcgctgttcttaatccaatgcaacagcaactccaggcaagaccatccttagccacggtacagacgccttcccaccctccccctccatatccctttggcagccagcaagcctcacaagcccacacaaactttcctcagatgagcaacccaggccagttcacagctcctcagatgaagagtttgcagggagggccctctagggtcccaactcccttgcagcagccccacctcaccaacaagtctcctgcctcctcaccctcctccttccagcagggatcccctgcatcctccccaacggttaaccaaactcagcagcagatgggaccaaggccacctcaaaataacccacttccccagggatttcagcagcctgtcagctctccgggtcggaatcctatggttcaacagggaaatgtgccacctaacttcatggtgatgcagcagcaaccaccaaaccaggggccacagagtttacatccaggcctaggaggaatgcctaaacgcctcccacctggcttctcagcaggacaggccaatccgaactttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcagaaccagtccaatgtcatgccgggaccagcccagataatgaggggaccaactccgaacatgcaaggaaatatggtgcagtttacgggacagatgtcaggacagatgctgccccagcaagggcctgtgaacaacagtccatctcaggttatgggcattcagggacaggtcctgcggccaccagggcccagcccacacatggcccagcagcatggtgatcctgctactacagcaaataacgatgtcagtttatctcagatgatgcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaacaccccagatactcgcccagctggtctggaagaggctgatcagccaccgttgcctggagaacaaggaattaacttggataactcaggccctaaactgccagaattttcaaaccggccaccaggttatccttctcaaccagttgaacagaggccacttcagcagatgcctcctcaactcatgcagcatgtggcacccccaccacagccaccacagcagcagccacagccacaactgcctcagcagcagcagccaccacctcccagtcagccacagtctcagcagcagcagcagcagcagcaacaaatgatgatgatgctcatgatgcagcaggatcccaaatcagttaggcttccagtctctcaaaatgtccatcctccaaggggccccctgaaccccgactcccagagaatgcccatgcaacagagtggcagtgtgcctgtcatggtcagtctgcaaggacctgcctccgtgccaccatcacctgataaacaaagaatgccaatgcctgtgaatactcccttgggaagcaattcaaggaaaatggtctatcaggagagcccgcagaatccttccagctcgccactggcggagatggcctcactccctgaagcaagtggcagtgaagcaccatctgtcccaggaggcccaaacaacatgccttcacatgtagtacttccccagaatcagttaatgatgacagggccaaaacctggaccatcgcccctttcagcaactcaaggtgcaactccccagcaaccccctgtaaattccctgcccagctctcacggccaccacttcccaaatgtggctgcgccaacccagacatctaggcccaaaacaccaaacagagccagccccagaccctattatcctcagacacccaacaaccgccctcccagcacagaaccttcagaaatcagtctgtcaccagaaagactcaatgcctccatagcaggactcttccctccacagattaatattcctttacctcctaggccaaatttaaacaggggctttgatcaacaaggcctaaatccaacaactttgaaggccatcgggcaagcaccttcaaatcttaccatgaatccttccaattttgctaccccacaaactcacaaattagattctgtggtagtgaattctggaaagcagtctaattctggagcaacaaaacgggcaagtccaagcaacagtcgcaggtctagtcctgggtccagtaggaaaaccactccaagccctgggaggcaaaattcaaaagcccctaaacttactctggcctctcagacaaatgcagccctattgcagaatgtggagttgccgagaaatgtattggtcagtcccactcctctggccaatccccctgtacctgggagctttcctaacaacagtgggctgaatcctcagaattctactgtgtctgtggctgcagttgggggtgttgttgaggataacaaggagagcttgaatgtgcctcaggacagtgattgccagaattcccagagtaggaaggaacaggtaaacattgaactaaaagcagtccctgcccaagaagttaaaatggttgtccctgaagatcagtccaaaaaggatgggcagccttcggatcctaacaaacttcccagtgtcgaagagaacaaaaatttggtgtctcctgctatgagggaagcaccaacatcgttaagtcaacttcttgacaactctggagctcccaatgtgacaattaaaccccctgggcttacagatctggaagtaacacctccagtagtttctggggaggacctcaaaaaagcatctgtcattcccacactgcaggatctgtcttcttctaaagaaccttctaattccctaaacttacctcacagtaatgagctgtgttcatcccttgtgcatcccgaattgagtgaggtcagttctaacgttgcaccaagcatccctccagtaatgtcaagacctgttagctcttcctccatttccactcccttgcccccaaatcaaataactgtatttgtcacttccaatcccatcacaacttcagctaacacatcagcagctttgccaactcacttgcagtctgcattgatgtcaacagttgtcacaatgcccaatgcgggtagcaaggttatggtttctgagggacagtcagctgctcagtctaatgcccggcctcagttcattacacctgtctttatcaattcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtcccttctcatccccctgtgcagcaagtgaaagaattgaatccagatgaggctagccctcaggtgaacacctcagcagatcagaacactcttccctcttcacagtcaaccacaatggtttctccccttttgaccaatagtccagggtcctctggcaaccggcgaagcccagtctcgtctagtaagggcaaaggaaaagtggacaaaattggccaaattttgttgaccaaggcatgtaagaaagttacaggctctcttgagaaaggggaagaacaatatggtgcagatggagagactgaaggccaagggctagacaccacagctccggggctcatgggaacagagcagttatccacagagctggacagtaaaaccccaacgcccccagcacccactctgctaaaaatgacctctagccctgtgggcccgggcactgcctcagcaggacccagcttacctggcggtgctctccccaccagtgtacgctcgatagtaaccactctggtaccctccgagctcatctccgccgtaccgaccacaaaaagcaatcatggtggcatagcatctgagtcacttgcgggtggcctagtggaggagaaggtgggatcccatccagaacttctacccagcatagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaaacaagcaggactgcgacttgatacttggaaatgtgtgtgacttttacaaagagcaattttgagctgtgacttttttaaatcaatttctgtacagttagtaattttaataatgtggcccttttcctagtccctgcaacctgtttcataaagtgcaatggggaaagcaggactgttgagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgatgtattgtgccgtggaagtactgtgtgtgaatagcagtagtgggggcaaaagcaatcttctcatttggaaatgttgtaaataattttattatatagtgttttggatgtatttgttgtagaaatggaccagtgaataaagagaatctaaggatttgtacaatgtgaaataacgtgttaaataaatgtcattgtcatagaacataaagttatgttattggtaaggga

SEQ ID NO: 336327 - DNA, 2224 bp, Homo sapiens
  misc_feature (13)..(13): n is a, c, g, or t
aattcctgcagcnccactgacaaccaactctggcctgatgcctccctctgttgcagttgttggccctttacacatacctcagaacataagatctgtcttcttctaaagaaccttctaattccctaaacttacctcacagtaatgagctgtgttcatcccttgtgcatcccgaattgagtgaggtcagttctaacgttgcaccaagcatccctccagtaatgtcaagacctgttagctcttcctccatttccactcccttgcccccaaatcaaataactgtatttgtcacttccaatcccatcacaacttcagctaacacatcagcagctttgccaactcacttgcagtctgcattgatgtcaacagttgtcacaatgcccaatgcgggtagcaaggttatggtttctgagggacagtcagctgctcagtctaatgcccggcctcagttcattacacctgtctttatcaattcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtcccttctcatccccctgtgcagcaagtgaaagaattgaatccagatgaggctagccctcaggtgaacacctcagcagatcagaacactcttccctcttcacagtcaaccacaatggtttctccccttttgaccaatagtccagggtcctctggcaaccggcgaagcccagtctcgtctagtaagggcaaaggaaaagtggacaaaattggccaaattttgttgaccaaggcatgtaagaaagttacaggctctcttgagaaaggggaagaacaatatggtgcagatggagagactgaaggccaagggctagacaccacagctccggggctcatgggaacagagcagttatccacagagctggacagtaaaaccccaacgcccccagcacccactctgctaaaaatgacctctagccctgtgggcccgggcactgcctcagcaggacccagcttacctggcggtgctctccccaccagtgtacgctcgatagtaaccactctggtaccctccgagctcatctccgccgtaccgaccacaaaaagcaatcatggtggcatagcatctgagtcacttgcgggtggcctagtggaggagaaggtgggatcccatccagaacttctacccagcatagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaaacaagcaggactgcgacttgatacttggaaatgtgtgtgacttttacaaagagcaattttgagctgtgacttttttaaatcaatttctgtacagttagtaattttaataatgtggcccttttcctagtccctgcaacctgtttcataaagtgcaatggggaaagcaggactgttgagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgatgtattgtgccgtggaagtactgtgtgtgaatagcagtagtgggggcaaaagcaatcttctcatttggaaatgttgtaaataattttattatatagtgttttggatgtatttgttgtagaaatggaccagtgaataaagagaatctaaggatttgtacaatgtgaaataacgtgttaaataaatgtcattgtcatagaacataaagttatgttattggtaaggga

SEQ ID NO: 336328 - DNA, 6287 bp, Homo sapiens
tggtgcctgaggatccacgtatatgtaaccaggctggagtacagtggtgccgtattggctcactgcaacctctgcctctgagttcatgtgattctcctgcctcagtctcccgagcagctgggattacagaattttgatttggctgctgggctgctaccttgaaatccaagccctaaaaatgccagcttctttggacttagaagatgacctggataaatgataaaaattaagaaagagattttgaagttttcttattgtcctcttggcatatgcttctggaataatattcaccatggttttggatgaccttccaaacttagaagacatctatacttccttgtgttcatcaacaatggaagactcagagatggattttgactctggactagaagatgatgacacaaaaagtgatagtattttggaggattccacaatttttgtggccttcaaaggaaatatagatgataaagacttcaaatggaaattagatgcaatattgaaaaacgtgcccaatttgttacacatggagtccagcaagctaaaagtacagaaggtggagccctggaacagcgtgcgtgtgacattcaacatcccccgggaagcagcggagcggctacggatccttgctcagagcaacaaccagcagcttcgggatttagggattctctccgttcagattgaaggggaaggtgctattaacctggctttggctcagaaccgaagccaagatgtgagaatgaatggacccatgggagctggaaattcagttaggatggaggcgggatttcctatggcaagtggtccaggaataataaggatgaacaaccctgccactgttatgatacccccgggtggaaatgtgtcatcttccatgatggcaccaggccccaatccagagctgcagcccaggactcctcgccctgcttctcagtcagatgcaatggatccactcctctctgggctccatatacagcagcaaagtcatccctcaggatctttagctcccccacatcacccaatgcagcctgtctctgtgaacagacaaatgaacccagctaattttccccagctgcagcagcagcagcaacaacaacaacagcagcagcagcagcagcagcagcaacaacagcaacagcagcaacaacagttgcaggcaagacccccacagcaacatcagcagcaacagccacagggaattcgaccccagtttactgccccaactcaggtgcctgttcctccaggctggaaccagctgccttctggagcccttcaacctcctccagcccagggttctctgggcacaatgactgcaaaccaagggtggaagaaggctcccttgcccggcccaatgcaacagcaactccaggcaagaccatccttagccacggtacagacgccttcccaccctccccctccatatccctttggcagccagcaagcctcacaagcccacacaaactttcctcagatgagcaacccaggccagttcacagctcctcagatgaagagtttgcagggagggccctctagggtcccaactcccttgcagcagccccacctcaccaacaagtctcctgcctcctcaccctcctccttccagcagggatcccctgcatcctccccaacggttaaccaaactcagcagcagatgggaccaaggccacctcaaaataacccacttccccagggatttcagcagcctgtcagctctccgggtcggaatcctatggttcaacagggaaatgtgccacctaacttcatggtgatgcagcagcaaccaccaaaccaggggccacagagtttacatccaggcctaggaggaatgcctaaacgcctcccacctggcttctcagcaggacaggccaatccgaactttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcagaaccagtccaatgtcatgccgggaccagcccagataatgaggggaccaactccgaacatgcaaggaaatatggtgcagtttacgggacagatgtcaggacagatgctgccccagcaagggcctgtgaacaacagtccatctcaggttatgggcattcagggacaggtcctgcggccaccagggcccagcccacacatggcccagcagcatggtgatcctgctactacagcaaataacgatgtcagtttatctcagatgatgcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaacaccccagatactcgcccagctggtctggaagaggctgatcagccaccgttgcctggagaacaaggaattaacttggataactcaggccctaaactgccagaattttcaaaccggccaccaggttatccttctcaaccagttgaacagaggccacttcagcagatgcctcctcaactcatgcagcatgtggcacccccaccacagccaccacagcagcagccacagccacaactgcctcagcagcagcagccaccacctcccagtcagccacagtctcagcagcagcagcagcagcagcaacaaatgatgatgatgctcatgatgcagcaggatcccaaatcagttaggcttccagtctctcaaaatgtccatcctccaaggggccccctgaaccccgactcccagagaatgcccatgcaacagagtggcagtgtgcctgtcatggtcagtctgcaaggacctgcctccgtgccaccatcacctgataaacaaagaatgccaatgcctgtgaatactcccttgggaagcaattcaaggaaaatggtctatcaggagagcccgcagaatccttccagctcgccactggcggagatggcctcactccctgaagcaagtggcagtgaagcaccatctgtcccaggaggcccaaacaacatgccttcacatgtagtacttccccagaatcagttaatgatgacagggccaaaacctggaccatcgcccctttcagcaactcaaggtgcaactccccagcaaccccctgtaaattccctgcccagctctcacggccaccacttcccaaatgtggctgcgccaacccagacatctaggcccaaaacaccaaacagagccagccccagaccctattatcctcagacacccaacaaccgccctcccagcacagaaccttcagaaatcagtctgtcaccagaaagactcaatgcctccatagcaggactcttccctccacagattaatattcctttacctcctaggccaaatttaaacaggggctttgatcaacaaggcctaaatccaacaactttgaaggccatcgggcaagcaccttcaaatcttaccatgaatccttccaattttgctaccccacaaactcacaaattagattctgtggtagtgaattctggaaagcagtctaattctggagcaacaaaacgggcaagtccaagcaacagtcgcaggtctagtcctgggtccagtaggaaaaccactccaagccctgggaggcaaaattcaaaagcccctaaacttactctggcctctcagacaaatgcagccctattgcagaatgtggagttgccgagaaatgtattggtcagtcccactcctctggccaatccccctgtacctgggagctttcctaacaacagtgggctgaatcctcagaattctactgtgtctgtggctgcagttgggggtgttgttgaggataacaaggagagcttgaatgtgcctcaggacagtgattgccagaattcccagagtaggaaggaacaggtaaacattgaactaaaagcagtccctgcccaagaagttaaaatggttgtccctgaagatcagtccaaaaaggatgggcagccttcggatcctaacaaacttcccagtgtcgaagagaacaaaaatttggtgtctcctgctatgagggaagcaccaacatcgttaagtcaacttcttgacaactctggagctcccaatgtgacaattaaaccccctgggcttacagatctggaagtaacacctccagtagtttctggggaggacctcaaaaaagcatctgtcattcccacactgcaggatctgtcttcttctaaagaaccttctaattccctaaacttacctcacagtaatgagctgtgttcatcccttgtgcatcccgaattgagtgaggtcagttctaacgttgcaccaagcatccctccagtaatgtcaagacctgttagctcttcctccatttccactcccttgcccccaaatcaaataactgtatttgtcacttccaatcccatcacaacttcagctaacacatcagcagctttgccaactcacttgcagtctgcattgatgtcaacagttgtcacaatgcccaatgcgggtagcaaggttatggtttctgagggacagtcagctgctcagtctaatgcccggcctcagttcattacacctgtctttatcaattcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtcccttctcatccccctgtgcagcaagtgaaagaattgaatccagatgaggctagccctcaggtgaacacctcagcagatcagaacactcttccctcttcacagtcaaccacaatggtttctccccttttgaccaatagtccagggtcctctggcaaccggcgaagcccagtctcgtctagtaagggcaaaggaaaagtggacaaaattggccaaattttgttgaccaaggcatgtaagaaagttacaggctctcttgagaaaggggaagaacaatatggtgcagatggagagactgaaggccaagggctagacaccacagctccggggctcatgggaacagagcagttatccacagagctggacagtaaaaccccaacgcccccagcacccactctgctaaaaatgacctctagccctgtgggcccgggcactgcctcagcaggacccagcttacctggcggtgctctccccaccagtgtacgctcgatagtaaccactctggtaccctccgagctcatctccgccgtaccgaccacaaaaagcaatcatggtggcatagcatctgagtcacttgcgggtggcctagtggaggagaaggtgggatcccatccagaacttctacccagcatagtagccggtcgaaattagtctcaaggaaatccacacagactgagcttgtgcaacaagtgagtatgtgccatttgcacactgccagtctcatcaacaggcgccg

SEQ ID NO: 336329 - DNA, 928 bp, Homo sapiens
aggcagtggggggacagcctggaaccagaacgcgaaacccagcctcacggtaagaagtggagacctagtggacactagcagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaaacaagcaggactgcgacttgatacttggaaatgtgtgtgacttttacaaagagcaattttgagctgtgacttttttaaatcaatttctgtacagttagtaattttaataatgtggcccttttcctagtccctgcaacctgtttcataaagtgcaatggggaaagcaggactgttgagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgatgtattgtgccgtggaagtactgtgtgtgaatagcagtagtgggggcaaaagcaatcttctcatttggaaatgttgtaaataattttattatatagtgttttggatgtatttgttgtagaaatggaccagtgaataaagagaatctaaggatttgtacaatgtgaaataacgtgttaaataaatgtcattgtcatagaacataaagttatgttattggtaaggga

SEQ ID NO: 336330 - DNA, 1151 bp, Homo sapiens
aaaagtggcaacaaggtggatggagatgttttaaaatgaaaacggtctcttccacatgagaggaagagacttattttgctaacctggttgtaactggatgaaatatgaacaaggaagggtgaacttagttctattaatccaaacagattatttcaccatgtggagtagaaataaaaatagaccaagtgtcttatgtcccaaacaaaccaagttgtatctgtgccagctttgtctccataccatgtagggtgagaatcctgctgggcacagggacactttagcctaaatagggcatagagaattcttgtagactcctagcttctctctgtggcagctcccacatttcatttctatcctttatatttttttgcagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaaacaagcaggactgcgacttgatacttggaaatgtgtgtgacttttacaaagagcaattttgagctgtgacttttttaaatcaatttctgtacagttagtaattttaataatgtggcccttttcctagtccctgcaacctgtttcataaagtgcaatggggaaagcaggactgttgagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgatgtattgtgccgtggaagtactgtgtgtgaatagcagtagtgggggcaaaagcaatcttctcatttggaaatgttgtaaataattttattatatagtgttttggatgtatttgttgtagaaatggaccagtgaataaagagaatctaaggatttgtacaatgtgaaataacgtgttaaataaatgtcattgtcatagaacataaagttatgttattggtaaggga

SEQ ID NO: 336331 - DNA, 168 bp, Homo sapiens
ccagcagcttcgggatttagggattctctccgttcagattgaaggtcttttactttgccatgtgcccatctagaccagaatcattacaacagtagaatatagcatgattttctgtgctgctttgtctgttcctctgctcttgtgtttcagaatgccaagcaactcatg

SEQ ID NO: 336332 - DNA, 428 bp, Homo sapiens
agtcatggctcattcagatcctacacaccgaggagctccaggttttttgatgctttgctttttgcttccttaagcactgtgccccttttgcttatgtcaagtaatgaggggctgccccctgccccaggagtgggcatgcctgagctgtttgtgcatagtctgtgccacctagatgagtattgcttggctatactctaaaggtagcaacattttcttgctgaaaaatctaacttccctaatttggggggcttgttttaggttatccttctcaaccagttgaacagaggccacttcagcagatgcctcctcaactcatgcagcatgtggcacccccaccacagccaccacagcagcagccacagccacaactgcctcagcagcagcagccaccacctcccagtcagccacagtctcagcagcagcagcag

SEQ ID NO: 336333 - DNA, 9280 bp, Homo sapiens
ctccagcccaggcaacagagcgtgactccgtctcaaaaaaaaaaaaaaaagtgaaaggaaaatgaggggagaattctcattgataataagggtgaaaaggtttttttggcagagtaatagagttttggaaaccattgcaaagctgtcaagtgtggtgtagtttttggttaaggaaatcagaggtgtcagcagacataaaagacaggggaaaacatgggaagtgtcctacctatagtgtagaaaaagcacaactatctatgtcagaggtcgacagactgtggtccataggtcaaatctggcccacgatctgtttttgtaaataacgttttattggaacatagccacactcatttatttatatattgtccatatcttcttttgtggtaccaatagcagagttgagtagtcgtgacagagatgtgttgtgtcagctcacaaagctggaaatactctttacaaaaacatttgccaacccctgatctatgtgtttgagtgttggatgttcaacctctaatttgcctccaatgtctatatgatgatagagaatgaataaacgtcttggctctgccctttgggctggattacccatgctctgtgtacctgcagcataacacagacccctgaatatttatatcagtcagtgatggcaaggtctattgttctggagtgtactgtgtggtaactgtggtagtgccagctttacacggattagataatgctcgggcttgttttgccattttttttattgggttgtcttttacaaaagatttatttatatattctgattattaatcctttgttgttggtagatattacagatgtcatttcccagtttcttgcttattttaattttttttttttttttttgagatgaagtcttgctctgtcgcccaggctggagtgcagtcgtgccatctcggctcattgtaacctccgtctcccaggttcaagtgattctcttgcctcagcctcccaagtggctgggactgcaggcatgtgccaccacgcctggctgatttttgtgtttttagtggggatggggtttcatcatgttggccaggctggtctcaaactcctgacctcaagtgatccacccgtcttggcctcctagagtgctgggattacaggtgtgagccactgcgcctggcctgttgcttattttaaaacatctgttttaaggtgtcatttgttaaaaagttctgaattttagtatcaactttatcaatcttttcctttaagatttgcagttattctttgttttgaggcagggtctcgctctgtcaccgaggctggagtgcagtggcgcgatctcggctcactgcagcctcaacctcctgggctcaagcaaccctcccacctcccatgccagttgagaccacaggcatgcgccaccatgccctgctattttttgcattttttgtagaggcggggtttcgccatgttgcccaggctagtctggaactcctgagctcaagcagtccacaaagtgctgggattacaggtgtgagctactgtgcccagcctgcaattattctttatattctggaatacctactgttgttttcaatggttagatctttaatgtatctggaatggattcttatgtgtagtgtaaggtcgggtccagtttcattttttttccctatgtataaccagtgatcccagcatcatttattgaatggggcttgctttcaaattgtgagctctttttggtggagtctgtctgaggtccttatgaagcactgctgcttgctgattgtgtgaccttggacaaataaaacctcattgcgcctcagtctttaaggataatagtaatctcatagggttttgtgaggattaaatgagtcaatatacataacgtgtaaaacagtgcttggcacctagaacatgctcaataaatattagctgtactttagcactactgttcatttctgattcctcagcacctggtacagagcaggggctcattttgctcaattaaattgccaaattaatttggttttcaggtcaatcagaatggtgagagttgggctgagtgttgcaggagatgcttccaaggagctacttagttttaggggctgccttagattatctgctaggatagaactcttctcacgccatcacttttgcagagaacttctgtagcagaggttgcaaactggcaacctgtggttggatttgacctgtataagtattttgtttggtttacacaatatttttaatgtcttaaaaatgtacacagacctctgagtttctgacttaaccttgaaaaattggaagatctgtcaacagcaagcccatattcatttatagcggtaaccagctgaaacttttaggtcctgggaggaatggagaggggtcccactgactaacttttctgagagtggtcagagagttcttaagcagaattttgatttggctgctgggctgctaccttgaaatccaagccctaaaaatgccagcttctttggacttagaagatgacctggataaatgataaaaattaagaaagagattttgaagttttcttattgtcctcttggcatatgcttctggaataatattcaccatggttttggatgaccttccaaacttagaagacatctatacttccttgtgttcatcaacaatggaagactcagagatggattttgactctggactagaagatgatgacacaaaaagtgatagtattttggaggattccacaatttttgtggccttcaaaggaaatatagatgataaagacttcaaatggaaattagatgcaatattgaaaaacgtgcccaatttgttacacatggagtccagcaagctaaaagtacagaaggtggagccctggaacagcgtgcgtgtgacattcaacatcccccgggaagcagcggagcggctacggatccttgctcagagcaacaaccagcagcttcgggatttagggattctctccgttcagattgaaggggaaggtgctattaacctggctttggctcagaaccgaagccaagatgtgagaatgaatggacccatgggagctggaaattcagttaggatggaggcgggatttcctatggcaagtggtccaggaataataaggatgaacaaccctgccactgttatgatacccccgggtggaaatgtgtcatcttccatgatggcaccaggccccaatccagagctgcagcccaggactcctcgccctgcttctcagtcagatgcaatggatccactcctctctgggctccatatacagcagcaaagtcatccctcaggatctttagctcccccacatcacccaatgcagcctgtctctgtgaacagacaaatgaacccagctaattttccccagctgcagcagcagcagcaacaacaacaacagcagcagcagcagcagcagcagcaacaacagcaacagcagcaacaacagttgcaggcaagacccccacagcaacatcagcagcaacagccacagggaattcgaccccagtttactgccccaactcaggtgcctgttcctccaggctggaaccagctgccttctggagcccttcaacctcctccagcccagggttctctgggcacaatgactgcaaaccaagggtggaagaaggctcccttgcccggcccaatgcaacagcaactccaggcaagaccatccttagccacggtacagacgccttcccaccctccccctccatatccctttggcagccagcaagcctcacaagcccacacaaactttcctcagatgagcaacccaggccagttcacagctcctcagatgaagagtttgcagggagggccctctagggtcccaactcccttgcagcagccccacctcaccaacaagtctcctgcctcctcaccctcctccttccagcagggatcccctgcatcctccccaacggttaaccaaactcagcagcagatgggaccaaggccacctcaaaataacccacttccccagggatttcagcagcctgtcagctctccgggtcggaatcctatggttcaacagggaaatgtgccacctaacttcatggtgatgcagcagcaaccaccaaaccaggggccacagagtttacatccaggcctaggaggaatgcctaaacgcctcccacctggcttctcagcaggacaggccaatccgaactttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcagaaccagtccaatgtcatgccgggaccagcccagataatgaggggaccaactccgaacatgcaaggaaatatggtgcagtttacgggacagatgtcaggacagatgctgccccagcaagggcctgtgaacaacagtccatctcaggttatgggcattcagggacaggtcctgcggccaccagggcccagcccacacatggcccagcagcatggtgatcctgctactacagcaaataacgatgtcagtttatctcagatgatgcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaacaccccagatactcgcccagctggtctggaagaggctgatcagccaccgttgcctggagaacaaggaattaacttggataactcaggccctaaactgccagaattttcaaaccggccaccaggttatccttctcaaccagttgaacagaggccacttcagcagatgcctcctcaactcatgcagcatgtggcacccccaccacagccaccacagcagcagccacagccacaactgcctcagcagcagcagccaccacctcccagtcagccacagtctcagcagcagcagcagcagcagcaacaaatgatgatgatgctcatgatgcagcaggatcccaaatcagttaggcttccagtctctcaaaatgtccatcctccaaggggccccctgaaccccgactcccagagaatgcccatgcaacagagtggcagtgtgcctgtcatggtcagtctgcaaggacctgcctccgtgccaccatcacctgataaacaaagaatgccaatgcctgtgaatactcccttgggaagcaattcaaggaaaatggtctatcaggagagcccgcagaatccttccagctcgccactggcggagatggcctcactccctgaagcaagtggcagtgaagcaccatctgtcccaggaggcccaaacaacatgccttcacatgtagtacttccccagaatcagttaatgatgacagggccaaaacctggaccatcgcccctttcagcaactcaaggtgcaactccccagcaaccccctgtaaattccctgcccagctctcacggccaccacttcccaaatgtggctgcgccaacccagacatctaggcccaaaacaccaaacagagccagccccagaccctattatcctcagacacccaacaaccgccctcccagcacagaaccttcagaaatcagtctgtcaccagaaagactcaatgcctccatagcaggactcttccctccacagattaatattcctttacctcctaggccaaatttaaacaggggctttgatcaacaaggcctaaatccaacaactttgaaggccatcgggcaagcaccttcaaatcttaccatgaatccttccaattttgctaccccacaaactcacaaattagattctgtggtagtgaattctggaaagcagtctaattctggagcaacaaaacgggcaagtccaagcaacagtcgcaggtctagtcctgggtccagtaggaaaaccactccaagccctgggaggcaaaattcaaaagcccctaaacttactctggcctctcagacaaatgcagccctattgcagaatgtggagttgccgagaaatgtattggtcagtcccactcctctggccaatccccctgtacctgggagctttcctaacaacagtgggctgaatcctcagaattctactgtgtctgtggctgcagttgggggtgttgttgaggataacaaggagagcttgaatgtgcctcaggacagtgattgccagaattcccagagtaggaaggaacaggtaaacattgaactaaaagcagtccctgcccaagaagttaaaatggttgtccctgaagatcagtccaaaaaggatgggcagccttcggatcctaacaaacttcccagtgtcgaagagaacaaaaatttggtgtctcctgctatgagggaagcaccaacatcgttaagtcaacttcttgacaactctggagctcccaatgtgacaattaaaccccctgggcttacagatctggaagtaacacctccagtagtttctggggaggacctcaaaaaagcatctgtcattcccacactgcaggatctgtcttcttctaaagaaccttctaattccctaaacttacctcacagtaatgagctgtgttcatcccttgtgcatcccgaattgagtgaggtcagttctaacgttgcaccaagcatccctccagtaatgtcaagacctgttagctcttcctccatttccactcccttgcccccaaatcaaataactgtatttgtcacttccaatcccatcacaacttcagctaacacatcagcagctttgccaactcacttgcagtctgcattgatgtcaacagttgtcacaatgcccaatgcgggtagcaaggttatggtttctgagggacagtcagctgctcagtctaatgcccggcctcagttcattacacctgtctttatcaattcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtcccttctcatccccctgtgcagcaagtgaaagaattgaatccagatgaggctagccctcaggtgaacacctcagcagatcagaacactcttccctcttcacagtcaaccacaatggtttctccccttttgaccaatagtccagggtcctctggcaaccggcgaagcccagtctcgtctagtaagggcaaaggaaaagtggacaaaattggccaaattttgttgaccaaggcatgtaagaaagttacaggctctcttgagaaaggggaagaacaatatggtgcagatggagagactgaaggccaagggctagacaccacagctccggggctcatgggaacagagcagttatccacagagctggacagtaaaaccccaacgcccccagcacccactctgctaaaaatgacctctagccctgtgggcccgggcactgcctcagcaggacccagcttacctggcggtgctctccccaccagtgtacgctcgatagtaaccactctggtaccctccgagctcatctccgccgtaccgaccacaaaaagcaatcatggtggcatagcatctgagtcacttgcgggtggcctagtggaggagaaggtgggatcccatccagaacttctacccagcatagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaaacaagcaggactgcgacttgatacttggaaatgtgtgtgacttttacaaagagcaattttgagctgtgacttttttaaatcaatttctgtacagttagtaattttaataatgtggcccttttcctagtccctgcaacctgtttcataaagtgcaatggggaaagcaggactgttgagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgatgtattgtgccgtggaagtactgtgtgtgaatagcagtagtgggggcaaaagcaatcttctcatttggaaatgttgtaaataattttattatatagtgttttggatgtatttgttgtagaaatggaccagtgaataaagagaatctaaggatttgtacaatgtgaaataacgtgttaaataaatgtcattgtcata

SEQ ID NO: 336334 - DNA, 7032 bp, Homo sapiens
tggtgcctgaggatccacgtatatgtaaccaggctggagtacagtggtgccgtattggctcactgcaacctctgcctctgagttcatgtgattctcctgcctcagtctcccgagcagctgggattacagaattttgatttggctgctgggctgctaccttgaaatccaagccctaaaaatgccagcttctttggacttagaagatgacctggataaatgataaaaattaagaaagagattttgaagttttcttattgtcctcttggcatatgcttctggaataatattcaccatggttttggatgaccttccaaacttagaagacatctatacttccttgtgttcatcaacaatggaagactcagagatggattttgactctggactagaagatgatgacacaaaaagtgatagtattttggaggattccacaatttttgtggccttcaaaggaaatatagatgataaagacttcaaatggaaattagatgcaatattgaaaaacgtgcccaatttgttacacatggagtccagcaagctaaaagtacagaaggtggagccctggaacagcgtgcgtgtgacattcaacatcccccgggaagcagcggagcggctacggatccttgctcagagcaacaaccagcagcttcgggatttagggattctctccgttcagattgaaggggaaggtgctattaacctggctttggctcagaaccgaagccaagatgtgagaatgaatggacccatgggagctggaaattcagttaggatggaggcgggatttcctatggcaagtggtccaggaataataaggatgaacaaccctgccactgttatgatacccccgggtggaaatgtgtcatcttccatgatggcaccaggccccaatccagagctgcagcccaggactcctcgccctgcttctcagtcagatgcaatggatccactcctctctgggctccatatacagcagcaaagtcatccctcaggatctttagctcccccacatcacccaatgcagcctgtctctgtgaacagacaaatgaacccagctaattttccccagctgcagcagcagcagcaacaacaacaacagcagcagcagcagcagcagcagcaacaacagcaacagcagcaacaacagttgcaggcaagacccccacagcaacatcagcagcaacagccacagggaattcgaccccagtttactgccccaactcaggtgcctgttcctccaggctggaaccagctgccttctggagcccttcaacctcctccagcccagggttctctgggcacaatgactgcaaaccaagggtggaagaaggctcccttgcccggcccaatgcaacagcaactccaggcaagaccatccttagccacggtacagacgccttcccaccctccccctccatatccctttggcagccagcaagcctcacaagcccacacaaactttcctcagatgagcaacccaggccagttcacagctcctcagatgaagagtttgcagggagggccctctagggtcccaactcccttgcagcagccccacctcaccaacaagtctcctgcctcctcaccctcctccttccagcagggatcccctgcatcctccccaacggttaaccaaactcagcagcagatgggaccaaggccacctcaaaataacccacttccccagggatttcagcagcctgtcagctctccgggtcggaatcctatggttcaacagggaaatgtgccacctaacttcatggtgatgcagcagcaaccaccaaaccaggggccacagagtttacatccaggcctaggaggaatgcctaaacgcctcccacctggcttctcagcaggacaggccaatccgaactttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcagaaccagtccaatgtcatgccgggaccagcccagataatgaggggaccaactccgaacatgcaaggaaatatggtgcagtttacgggacagatgtcaggacagatgctgccccagcaagggcctgtgaacaacagtccatctcaggttatgggcattcagggacaggtcctgcggccaccagggcccagcccacacatggcccagcagcatggtgatcctgctactacagcaaataacgatgtcagtttatctcagatgatgcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaacaccccagatactcgcccagctggtctggaagaggctgatcagccaccgttgcctggagaacaaggaattaacttggataactcaggccctaaactgccagaattttcaaaccggccaccaggttatccttctcaaccagttgaacagaggccacttcagcagatgcctcctcaactcatgcagcatgtggcacccccaccacagccaccacagcagcagccacagccacaactgcctcagcagcagcagccaccacctcccagtcagccacagtctcagcagcagcagcagcagcagcaacaaatgatgatgatgctcatgatgcagcaggatcccaaatcagttaggcttccagtctctcaaaatgtccatcctccaaggggccccctgaaccccgactcccagagaatgcccatgcaacagagtggcagtgtgcctgtcatggtcagtctgcaaggacctgcctccgtgccaccatcacctgataaacaaagaatgccaatgcctgtgaatactcccttgggaagcaattcaaggaaaatggtctatcaggagagcccgcagaatccttccagctcgccactggcggagatggcctcactccctgaagcaagtggcagtgaagcaccatctgtcccaggaggcccaaacaacatgccttcacatgtagtacttccccagaatcagttaatgatgacagggccaaaacctggaccatcgcccctttcagcaactcaaggtgcaactccccagcaaccccctgtaaattccctgcccagctctcacggccaccacttcccaaatgtggctgcgccaacccagacatctaggcccaaaacaccaaacagagccagccccagaccctattatcctcagacacccaacaaccgccctcccagcacagaaccttcagaaatcagtctgtcaccagaaagactcaatgcctccatagcaggactcttccctccacagattaatattcctttacctcctaggccaaatttaaacaggggctttgatcaacaaggcctaaatccaacaactttgaaggccatcgggcaagcaccttcaaatcttaccatgaatccttccaattttgctaccccacaaactcacaaattagattctgtggtagtgaattctggaaagcagtctaattctggagcaacaaaacgggcaagtccaagcaacagtcgcaggtctagtcctgggtccagtaggaaaaccactccaagccctgggaggcaaaattcaaaagcccctaaacttactctggcctctcagacaaatgcagccctattgcagaatgtggagttgccgagaaatgtattggtcagtcccactcctctggccaatccccctgtacctgggagctttcctaacaacagtgggctgaatcctcagaattctactgtgtctgtggctgcagttgggggtgttgttgaggataacaaggagagcttgaatgtgcctcaggacagtgattgccagaattcccagagtaggaaggaacaggtaaacattgaactaaaagcagtccctgcccaagaagttaaaatggttgtccctgaagatcagtccaaaaaggatgggcagccttcggatcctaacaaacttcccagtgtcgaagagaacaaaaatttggtgtctcctgctatgagggaagcaccaacatcgttaagtcaacttcttgacaactctggagctcccaatgtgacaattaaaccccctgggcttacagatctggaagtaacacctccagtagtttctggggaggacctcaaaaaagcatctgtcattcccacactgcaggatctgtcttcttctaaagaaccttctaattccctaaacttacctcacagtaatgagctgtgttcatcccttgtgcatcccgaattgagtgaggtcagttctaacgttgcaccaagcatccctccagtaatgtcaagacctgttagctcttcctccatttccactcccttgcccccaaatcaaataactgtatttgtcacttccaatcccatcacaacttcagctaacacatcagcagctttgccaactcacttgcagtctgcattgatgtcaacagttgtcacaatgcccaatgcgggtagcaaggttatggtttctgagggacagtcagctgctcagtctaatgcccggcctcagttcattacacctgtctttatcaattcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtcccttctcatccccctgtgcagcaagtgaaagaattgaatccagatgaggctagccctcaggtgaacacctcagcagatcagaacactcttccctcttcacagtcaaccacaatggtttctccccttttgaccaatagtccagggtcctctggcaaccggcgaagcccagtctcgtctagtaagggcaaaggaaaagtggacaaaattggccaaattttgttgaccaaggcatgtaagaaagttacaggctctcttgagaaaggggaagaacaatatggtgcagatggagagactgaaggccaagggctagacaccacagctccggggctcatgggaacagagcagttatccacagagctggacagtaaaaccccaacgcccccagcacccactctgctaaaaatgacctctagccctgtgggcccgggcactgcctcagcaggacccagcttacctggcggtgctctccccaccagtgtacgctcgatagtaaccactctggtaccctccgagctcatctccgccgtaccgaccacaaaaagcaatcatggtggcatagcatctgagtcacttgcgggtggcctagtggaggagaaggtgggatcccatccagaacttctacccagcatagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaaacaagcaggactgcgacttgatacttggaaatgtgtgtgacttttacaaagagcaattttgagctgtgacttttttaaatcaatttctgtacagttagtaattttaataatgtggcccttttcctagtccctgcaacctgtttcataaagtgcaatggggaaagcaggactgttgagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgatgtattgtgccgtggaagtactgtgtgtgaatagcagtagtgggggcaaaagcaatcttctcatttggaaatgttgtaaataattttattatatagtgttttggatgtatttgttgtagaaatggaccagtgaataaagagaatctaaggatttgtacaatgtgaaataacgtgttaaataaatgtcattgtcatagaacataaagttatgttattggtaaggga

SEQ ID NO: 336335 - DNA, 7731 bp, Homo sapiens
tggtgcctgaggatccacgtatatgtaaccaggctggagtacagtggtgccgtattggctcactgcaacctctgcctctgagttcatgtgattctcctgcctcagtctcccgagcagctgggattacagaattttgatttggctgctgggctgctaccttgaaatccaagccctaaaaatgccagcttctttggacttagaagatgacctggataaatgataaaaattaagaaagagattttgaagttttcttattgtcctcttggcatatgcttctggaataatattcaccatggttttggatgaccttccaaacttagaagacatctatacttccttgtgttcatcaacaatggaagactcagagatggattttgactctggactagaagatgatgacacaaaaagtgatagtattttggaggattccacaatttttgtggccttcaaaggaaatatagatgataaagacttcaaatggaaattagatgcaatattgaaaaacgtgcccaatttgttacacatggagtccagcaagctaaaagtacagaaggtggagccctggaacagcgtgcgtgtgacattcaacatcccccgggaagcagcggagcggctacggatccttgctcagagcaacaaccagcagcttcgggatttagggattctctccgttcagattgaaggggaaggtgctattaacctggctttggctcagaaccgaagccaagatgtgagaatgaatggacccatgggagctggaaattcagttaggatggaggcgggatttcctatggcaagtggtccaggaataataaggatgaacaaccctgccactgttatgatacccccgggtggaaatgtgtcatcttccatgatggcaccaggccccaatccagagctgcagcccaggactcctcgccctgcttctcagtcaggtaatgacttccaatctttgaggatgaagagtctgaaactttctgcacagatcattataaaattcagttatctctgatgctgaatttctaatttccaaactcacaatgtcaaccttctttacaaaatctgacctgatttcttcaaactaaatgtcattattttcttttcagaatttctcattgttttcttatcaattataccccaacatttctaaaagtgtgcctggcctgcgtagtcctgcaagatgctcattacatagaattctgtagtcaagtaaatttggtaaatgcatcattctttaccctccctcctggagattcaaaagtaacatattggaggcactgaaagtcctacagtgaagaaacgcatctaagtttgttaggttcagtgtttcccaaacctaattgttttgttttcttataatgctaattaacatagttctccagaatatgatttggtaaatactggtctccatgttttacacttcgctcttaatgtccactactgaccaagctctttttaagacagaattcatcatcttggtatgttgcttcatacatagaaggtattcacaagcatttattttatcgaatagtaccagcagattttgctctgtatatccagaattacaaaggccacttctctaagatctagattgcagtaggttaattattgctttgttgactatctttaaacagatgcaatggatccactcctctctgggctccatatacagcagcaaagtcatccctcaggatctttagctcccccacatcacccaatgcagcctgtctctgtgaacagacaaatgaacccagctaattttccccagctgcagcagcagcagcaacaacaacaacagcagcagcagcagcagcagcagcaacaacagcaacagcagcaacaacagttgcaggcaagacccccacagcaacatcagcagcaacagccacagggaattcgaccccagtttactgccccaactcaggtgcctgttcctccaggctggaaccagctgccttctggagcccttcaacctcctccagcccagggttctctgggcacaatgactgcaaaccaagggtggaagaaggctcccttgcccggcccaatgcaacagcaactccaggcaagaccatccttagccacggtacagacgccttcccaccctccccctccatatccctttggcagccagcaagcctcacaagcccacacaaactttcctcagatgagcaacccaggccagttcacagctcctcagatgaagagtttgcagggagggccctctagggtcccaactcccttgcagcagccccacctcaccaacaagtctcctgcctcctcaccctcctccttccagcagggatcccctgcatcctccccaacggttaaccaaactcagcagcagatgggaccaaggccacctcaaaataacccacttccccagggatttcagcagcctgtcagctctccgggtcggaatcctatggttcaacagggaaatgtgccacctaacttcatggtgatgcagcagcaaccaccaaaccaggggccacagagtttacatccaggcctaggaggaatgcctaaacgcctcccacctggcttctcagcaggacaggccaatccgaactttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcagaaccagtccaatgtcatgccgggaccagcccagataatgaggggaccaactccgaacatgcaaggaaatatggtgcagtttacgggacagatgtcaggacagatgctgccccagcaagggcctgtgaacaacagtccatctcaggttatgggcattcagggacaggtcctgcggccaccagggcccagcccacacatggcccagcagcatggtgatcctgctactacagcaaataacgatgtcagtttatctcagatgatgcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaacaccccagatactcgcccagctggtctggaagaggctgatcagccaccgttgcctggagaacaaggaattaacttggataactcaggccctaaactgccagaattttcaaaccggccaccaggttatccttctcaaccagttgaacagaggccacttcagcagatgcctcctcaactcatgcagcatgtggcacccccaccacagccaccacagcagcagccacagccacaactgcctcagcagcagcagccaccacctcccagtcagccacagtctcagcagcagcagcagcagcagcaacaaatgatgatgatgctcatgatgcagcaggatcccaaatcagttaggcttccagtctctcaaaatgtccatcctccaaggggccccctgaaccccgactcccagagaatgcccatgcaacagagtggcagtgtgcctgtcatggtcagtctgcaaggacctgcctccgtgccaccatcacctgataaacaaagaatgccaatgcctgtgaatactcccttgggaagcaattcaaggaaaatggtctatcaggagagcccgcagaatccttccagctcgccactggcggagatggcctcactccctgaagcaagtggcagtgaagcaccatctgtcccaggaggcccaaacaacatgccttcacatgtagtacttccccagaatcagttaatgatgacagggccaaaacctggaccatcgcccctttcagcaactcaaggtgcaactccccagcaaccccctgtaaattccctgcccagctctcacggccaccacttcccaaatgtggctgcgccaacccagacatctaggcccaaaacaccaaacagagccagccccagaccctattatcctcagacacccaacaaccgccctcccagcacagaaccttcagaaatcagtctgtcaccagaaagactcaatgcctccatagcaggactcttccctccacagattaatattcctttacctcctaggccaaatttaaacaggggctttgatcaacaaggcctaaatccaacaactttgaaggccatcgggcaagcaccttcaaatcttaccatgaatccttccaattttgctaccccacaaactcacaaattagattctgtggtagtgaattctggaaagcagtctaattctggagcaacaaaacgggcaagtccaagcaacagtcgcaggtctagtcctgggtccagtaggaaaaccactccaagccctgggaggcaaaattcaaaagcccctaaacttactctggcctctcagacaaatgcagccctattgcagaatgtggagttgccgagaaatgtattggtcagtcccactcctctggccaatccccctgtacctgggagctttcctaacaacagtgggctgaatcctcagaattctactgtgtctgtggctgcagttgggggtgttgttgaggataacaaggagagcttgaatgtgcctcaggacagtgattgccagaattcccagagtaggaaggaacaggtaaacattgaactaaaagcagtccctgcccaagaagttaaaatggttgtccctgaagatcagtccaaaaaggatgggcagccttcggatcctaacaaacttcccagtgtcgaagagaacaaaaatttggtgtctcctgctatgagggaagcaccaacatcgttaagtcaacttcttgacaactctggagctcccaatgtgacaattaaaccccctgggcttacagatctggaagtaacacctccagtagtttctggggaggacctcaaaaaagcatctgtcattcccacactgcaggatctgtcttcttctaaagaaccttctaattccctaaacttacctcacagtaatgagctgtgttcatcccttgtgcatcccgaattgagtgaggtcagttctaacgttgcaccaagcatccctccagtaatgtcaagacctgttagctcttcctccatttccactcccttgcccccaaatcaaataactgtatttgtcacttccaatcccatcacaacttcagctaacacatcagcagctttgccaactcacttgcagtctgcattgatgtcaacagttgtcacaatgcccaatgcgggtagcaaggttatggtttctgagggacagtcagctgctcagtctaatgcccggcctcagttcattacacctgtctttatcaattcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtcccttctcatccccctgtgcagcaagtgaaagaattgaatccagatgaggctagccctcaggtgaacacctcagcagatcagaacactcttccctcttcacagtcaaccacaatggtttctccccttttgaccaatagtccagggtcctctggcaaccggcgaagcccagtctcgtctagtaagggcaaaggaaaagtggacaaaattggccaaattttgttgaccaaggcatgtaagaaagttacaggctctcttgagaaaggggaagaacaatatggtgcagatggagagactgaaggccaagggctagacaccacagctccggggctcatgggaacagagcagttatccacagagctggacagtaaaaccccaacgcccccagcacccactctgctaaaaatgacctctagccctgtgggcccgggcactgcctcagcaggacccagcttacctggcggtgctctccccaccagtgtacgctcgatagtaaccactctggtaccctccgagctcatctccgccgtaccgaccacaaaaagcaatcatggtggcatagcatctgagtcacttgcgggtggcctagtggaggagaaggtgggatcccatccagaacttctacccagcatagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaaacaagcaggactgcgacttgatacttggaaatgtgtgtgacttttacaaagagcaattttgagctgtgacttttttaaatcaatttctgtacagttagtaattttaataatgtggcccttttcctagtccctgcaacctgtttcataaagtgcaatggggaaagcaggactgttgagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgatgtattgtgccgtggaagtactgtgtgtgaatagcagtagtgggggcaaaagcaatcttctcatttggaaatgttgtaaataattttattatatagtgttttggatgtatttgttgtagaaatggaccagtgaataaagagaatctaaggatttgtacaatgtgaaataacgtgttaaataaatgtcattgtcatagaacataaagttatgttattggtaaggga

SEQ ID NO: 336336 - DNA, 4005 bp, Homo sapiens
ctctagagtatccccgtgtgctcctcggaagaagaaaaatagtcagcaagatctaaacaccccagatactcgcccagctggtctggaagaggctgatcagccaccgttgcctggagaacaaggaattaacttggataactcaggccctaaactgccagaattttcaaaccggccaccaggttatccttctcaaccagttgaacagaggccacttcagcagatgcctcctcaactcatgcagcatgtggcacccccaccacagccaccacagcagcagccacagccacaactgcctcagcagcagcagccaccacctcccagtcagccacagtctcagcagcagcagcagcagcagcaacaaatgatgatgatgctcatgatgcagcaggatcccaaatcagttaggcttccagtctctcaaaatgtccatcctccaaggggccccctgaaccccgactcccagagaatgcccatgcaacagagtggcagtgtgcctgtcatggtcagtctgcaaggacctgcctccgtgccaccatcacctgataaacaaagaatgccaatgcctgtgaatactcccttgggaagcaattcaaggaaaatggtctatcaggagagcccgcagaatccttccagctcgccactggcggagatggcctcactccctgaagcaagtggcagtgaagcaccatctgtcccaggaggcccaaacaacatgccttcacatgtagtacttccccagaatcagttaatgatgacagggccaaaacctggaccatcgcccctttcagcaactcaaggtgcaactccccagcaaccccctgtaaattccctgcccagctctcacggccaccacttcccaaatgtggctgcgccaacccagacatctaggcccaaaacaccaaacagagccagccccagaccctattatcctcagacacccaacaaccgccctcccagcacagaaccttcagaaatcagtctgtcaccagaaagactcaatgcctccatagcaggactcttccctccacagattaatattcctttacctcctaggccaaatttaaacaggggctttgatcaacaaggcctaaatccaacaactttgaaggccatcgggcaagcaccttcaaatcttaccatgaatccttccaattttgctaccccacaaactcacaaattagattctgtggtagtgaattctggaaagcagtctaattctggagcaacaaaacgggcaagtccaagcaacagtcgcaggtctagtcctgggtccagtaggaaaaccactccaagccctgggaggcaaaattcaaaagcccctaaacttactctggcctctcagacaaatgcagccctattgcagaatgtggagttgccgagaaatgtattggtcagtcccactcctctggccaatccccctgtacctgggagctttcctaacaacagtgggctgaatcctcagaattctactgtgtctgtggctgcagttgggggtgttgttgaggataacaaggagagcttgaatgtgcctcaggacagtgattgccagaattcccagagtaggaaggaacaggtaaacattgaactaaaagcagtccctgcccaagaagttaaaatggttgtccctgaagatcagtccaaaaaggatgggcagccttcggatcctaacaaacttcccagtgtcgaagagaacaaaaatttggtgtctcctgctatgagggaagcaccaacatcgttaagtcaacttcttgacaactctggagctcccaatgtgacaattaaaccccctgggcttacagatctggaagtaacacctccagtagtttctggggaggacctcaaaaaagcatctgtcattcccacactgcaggatctgtcttcttctaaagaaccttctaattccctaaacttacctcacagtaatgagctgtgttcatcccttgtgcatcccgaattgagtgaggtcagttctaacgttgcaccaagcatccctccagtaatgtcaagacctgttagctcttcctccatttccactcccttgcccccaaatcaaataactgtatttgtcacttccaatcccatcacaacttcagctaacacatcagcagctttgccaactcacttgcagtctgcattgatgtcaacagttgtcacaatgcccaatgcgggtagcaaggttatggtttctgagggacagtcagctgctcagtctaatgcccggcctcagttcattacacctgtctttatcaattcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtcccttctcatccccctgtgcagcaagtgaaagaattgaatccagatgaggctagccctcaggtgaacacctcagcagatcagaacactcttccctcttcacagtcaaccacaatggtttctccccttttgaccaatagtccagggtcctctggcaaccggcgaagcccagtctcgtctagtaagggcaaaggaaaagtggacaaaattggccaaattttgttgaccaaggcatgtaagaaagttacaggctctcttgagaaaggggaagaacaatatggtgcagatggagagactgaaggccaagggctagacaccacagctccggggctcatgggaacagagcagttatccacagagctggacagtaaaaccccaacgcccccagcacccactctgctaaaaatgacctctagccctgtgggcccgggcactgcctcagcaggacccagcttacctggcggtgctctccccaccagtgtacgctcgatagtaaccactctggtaccctccgagctcatctccgccgtaccgaccacaaaaagcaatcatggtggcatagcatctgagtcacttgcgggtggcctagtggaggagaaggtgggatcccatccagaacttctacccagcatagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaaacaagcaggactgcgacttgatacttggaaatgtgtgtgacttttacaaagagcaattttgagctgtgacttttttaaatcaatttctgtacagttagtaattttaataatgtggcccttttcctagtccctgcaacctgtttcataaagtgcaatggggaaagcaggactgttgagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgatgtattgtgccgtggaagtactgtgtgtgaatagcagtagtgggggcaaaagcaatcttctcatttggaaatgttgtaaataattttattatatagtgttttggatgtatttgttgtagaaatggaccagtgaataaagagaatctaaggatttgtacaatgtgaaataacgtgttaaataaatgtcattgtcatagaacataaagttatgttattggtaaggga

SEQ ID NO: 336337 - DNA, 4053 bp, Homo sapiens
tggtgcctgaggatccacgtatatgtaaccaggctggagtacagtggtgccgtattggctcactgcaacctctgcctctgagttcatgtgattctcctgcctcagtctcccgagcagctgggattacagaattttgatttggctgctgggctgctaccttgaaatccaagccctaaaaatgccagcttctttggacttagaagatgacctggataaatgataaaaattaagaaagagattttgaagttttcttattgtcctcttggcatatgcttctggaataatattcaccatggttttggatgaccttccaaacttagaagacatctatacttccttgtgttcatcaacaatggaagactcagagatggattttgactctggactagaagatgatgacacaaaaagtgatagtattttggaggattccacaatttttgtggccttcaaaggaaatatagatgataaagacttcaaatggaaattagatgcaatattgaaaaacgtgcccaatttgttacacatggagtccagcaagctaaaagtacagaaggtggagccctggaacagcgtgcgtgtgacattcaacatcccccgggaagcagcggagcggctacggatccttgctcagagcaacaaccagcagcttcgggatttagggattctctccgttcagattgaaggggaaggtgctattaacctggctttggctcagaaccgaagccaagatgtgagaatgaatggacccatgggagctggaaattcagttaggatggaggcgggatttcctatggcaagtggtccaggaataataaggatgaacaaccctgccactgttatgatacccccgggtggaaatgtgtcatcttccatgatggcaccaggccccaatccagagctgcagcccaggactcctcgccctgcttctcagtcagatgcaatggatccactcctctctgggctccatatacagcagcaaagtcatccctcaggatctttagctcccccacatcacccaatgcagcctgtctctgtgaacagacaaatgaacccagctaattttccccagctgcagcagcagcagcaacaacaacaacagcagcagcagcagcagcagcagcaacaacagcaacagcagcaacaacagttgcaggcaagacccccacagcaacatcagcagcaacagccacagggaattcgaccccagtttactgccccaactcaggtgcctgttcctccaggctggaaccagctgccttctggagcccttcaacctcctccagcccagggttctctgggcacaatgactgcaaaccaagggtggaagaaggctcccttgcccggcccaatgcaacagcaactccaggcaagaccatccttagccacggtacagacgccttcccaccctccccctccatatccctttggcagccagcaagcctcacaagcccacacaaactttcctcagatgagcaacccaggccagttcacagctcctcagatgaagagtttgcagggagggccctctagggtcccaactcccttgcagcagccccacctcaccaacaagtctcctgcctcctcaccctcctccttccagcagggatcccctgcatcctccccaacggttaaccaaactcagcagcagatgggaccaaggccacctcaaaataacccacttccccagggatttcagcagcctgtcagctctccgggtcggaatcctatggttcaacagggaaatgtgccacctaacttcatggtgatgcagcagcaaccaccaaaccaggggccacagagtttacatccaggcctaggaggaatgcctaaacgcctcccacctggcttctcagcaggacaggccaatccgaactttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcagaaccagtccaatgtcatgccgggaccagcccagataatgaggggaccaactccgaacatgcaaggaaatatggtgcagtttacgggacagatgtcaggacagatgctgccccagcaagggcctgtgaacaacagtccatctcaggttatgggcattcagggacaggtcctgcggccaccagggcccagcccacacatggcccagcagcatggtgatcctgctactacagcaaataacgatgtcagtttatctcagatgatgcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaacaccccagatactcgcccagctggtctggaagaggctgatcagccaccgttgcctggagaacaaggaattaacttggataactcaggccctaaactgccagaattttcaaaccggccaccagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaaacaagcaggactgcgacttgatacttggaaatgtgtgtgacttttacaaagagcaattttgagctgtgacttttttaaatcaatttctgtacagttagtaattttaataatgtggcccttttcctagtccctgcaacctgtttcataaagtgcaatggggaaagcaggactgttgagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgatgtattgtgccgtggaagtactgtgtgtgaatagcagtagtgggggcaaaagcaatcttctcatttggaaatgttgtaaataattttattatatagtgttttggatgtatttgttgtagaaatggaccagtgaataaagagaatctaaggatttgtacaatgtgaaataacgtgttaaataaatgtcattgtcatagaacataaagttatgttattggtaaggga

SEQ ID NO: 336338 - DNA, 83 bp, Homo sapiens
atttctagaaatattttaaggtcccttagctgtaaattgtatttgattagtttttttttatactaaggtataaaatttacaaa

SEQ ID NO: 336339 - DNA, 170 bp, Homo sapiens
tcaccgctgtcctgtctggtttgcagatccttctggccgggcttcagttcatctgtattctgcctggaatgcagcattccttaggtggcctggccgctgcatactctctcccttcctcctggatggcgtccttctagcctcacagcctgagatagaatttctttactaca

SEQ ID NO: 336340 - DNA, 2221 bp, Homo sapiens
cgccggcagagaccagccggcgggtggcggcggcccccagcacggccggtgcaaggcctcgggttaagcggcggccgagcggggctcggcccggggtgctcggggagctcgccgcggcgggcagcaggaggaagcggcggcggcgcgtcccgagcggtgcgcgccatggcgggcgggccccccaaggccctgccgtccacggggccccactccctgcgcgacatgccgcacccgctggccggctccagcagcgaggaggccgtgggtggtgacagcacgcccagcccggacctgctgatggcccgcagcttcggtgacaaggatctcattttgcccaacggtggtactccagcaggtacttcaagtccagcttcttcatcttcccttctcaacagacttcagcttgatgatgatattgatggtgagactagagatctcttcgttatagttgatgatcccaagaagcatgtgtgtacaatggagacttacatcacctataggatcaccaccaaaagtactcgggtggagtttgacctgccagaatattctgttcgtcgaagataccaggattttgactggttgaggagcaaactggaagaatcccagcccactcatctcattccccctcttcccgagaagtttgtggtaaaaggtgttgtggatcgtttttcagaagagtttgtggagaccagaagaaaagctttggataaatttctaaaaagaattacggaccatcctgtgctgtctttcaatgaacactttaatattttccttactgctaaggacctgaacgcctacaagaagcaagggatagcattgctgaccagaatgggcgagtcagtcaagcacgtcactggcggctacaagctgaggactcggccgcttgagtttgctgccataggtgactacttagatacatttgcactcaaactgggaaccattgatcgaatagcccagcggatcatcaaagaagaaatagagtaccttgtggagctgagagaatacgggcctgtgtactccacatggagcgccttggagggtgagctggctgaacccctggagggtgtgtcagcttgcattgggaactgctctacagccttagaagagctgacagatgacatgacagaagacttcctacctgtgctcagggaatatattttatactctgactccatgaagagtgtattgaagaagagggaccaagttcaagcagagtatgaagccaaactggaagctgtggctctgcggaaggaagaccgccccaaggtaccggcggacgtcgagaaatgtcaggatcggatggagtgtttcaatgctgacctgaaagctgacatggagaggtggcagaacaacaagaggcaggacttccggcagctactcatggggatggctgacaagaacatccagtattatgagaagtgcctcatggcgtgggagtcgattattccactactgcaggagaaacaagaggccaagtaaagttctttcttgggacggagactcttctacctacacagggcctggcaccctataccggaatgtccctgcagtgccagagacgcagtgctgggaaaacaaccacagaaacatctctcctttgtgtatttttccctcccccacctttcaccccacagtggttttcaattagtatttattccatggtggagtctgtgaggctagaatatctctcagcaagagcagcatacctccatgttatgaaggcatctgttcagtgaagcactacgaaaatttgaaaccaagggacaagacaacctgcagctgacgctctgacatttcatgacagtttcctctttagggacagctgagttgccagttgtgggagagaacccggggcctgcttttcaaggatgaggaggaggcaggaacagaaggcagctgctgctttctgtggaaacctggcccctctggaattggcctctgtgggcattgacttgtcttggcctaggaggcattggtgcctccctggcaagtccttaacgtacagtacctgtagctgtgagtgtggcctgctgcctgcttgtgatgagtgataccgtcttactgtttctgtttcacatagggacatttaaatcaatgtcaatgtgcgtccatgcttgagtgagcaagccagcgtccttgtcctcctgcaatgcctttgggaagctcaggggaatgctccccaagcttgtttctgacactagaatgcaacagattggaaact

SEQ ID NO: 336341 - DNA, 387 bp, Homo sapiens
gcaggcatcattagacaaaggtaacccagcaggatcgacaacgaaagggtaggtcagagcagaattgaagctgacccgaaatcggaaactcaaagctgatactgtgtgtgtatgttgtcgttccagtgcctcatggcgtgggagtcgattattccactactgcaggagaaacaagaggccaagtaaagttctttcttgggacggagactcttctacctacacagggcctggcaccctataccggaatgtccctgcagtgccagagacgcagtgctgggaaaacaaccacagaaacatctctcctttgtgtatttttccctcccccacctttcaccccacagtggttttcaattagtatttattccatggtggagtctgtgaggctag

SEQ ID NO: 336342 - DNA, 1460 bp, Homo sapiens
cgccggcagagaccagccggcgggtggcggcggcccccagcacggccggtgcaaggcctcgggttaagcggcggccgagcggggctcggcccggggtgctcggggagctcgccgcggcgggcagcaggaggaagcggcggcggcgcgtcccgagcggtgcgcgccatggcgggcgggccccccaaggccctgccgtccacggggccccactccctgcgcgacatgccgcacccgctggccggctccagcagcgaggaggccgtgggtggtgacagcacgcccagcccggacctgctgatggcccgcagcttcggtgacaaggatctcattttgcccaacggtggtactccagcaggtacttcaagtccagcttcttcatcttcccttctcaacagacttcagcttgatgatgatattgatggtgagactagagatctcttcgttatagttgatgatcccaagaagcatgtgtgtacaatggagacttacatcacctataggatcaccaccaaaagtactcgggtggagtttgacctgccagaatattctgttcgtcgaagataccaggattttgactggttgaggagcaaactggaagaatcccagcccactcatctcattccccctcttcccgagaagtttgtggtaaaaggtgttgtggatcgtttttcagaagagtttgtggagaccagaagaaaagctttggataaatttctaaaaagaattacggaccatcctgtgctgtctttcaatgaacactttaatattttccttactgctaaggacctgaacgcctacaagaagcaagggatagcattgctgaccagaatgggcgagtcagtcaagcacgtcactggcggctacaagctgaggactcggccgcttgagtttgctgccataggtgactacttagatacatttgcactcaaactgggaaccattgatcgaatagcccagcggatcatcaaagaagaaatagagtaccttgtggagctgagagaatacgggcctgtgtactccacatggagcgccttggagggtgagctggctgaacccctggagggtgtgtcagcttgcattgggaactgctctacagccttagaagagctgacagatgacatgacagaagacttcctacctgtgctcagggaatatattttatactctgactccatgaagagtgtattgaagaagagggaccaagttcaagcagagtatgaagccaaactggaagctgtggctctgcggaaggaagaccgccccaaggtaccggcggacgtcgagaaatgtcaggatcggatggagtgtttcaatgctgacctgaaagctgacatggagaggtggcagaacaacaagaggcaggacttccggcagctactcatggggatggctgacaagaacatccagtattatgagaagtccattgcagatctgaagtgatggcctagggagagagcagg

SEQ ID NO: 336343 - DNA, 373 bp, Homo sapiens
gtctagccgcaactatcagagccagggtccccttccctgtgcccgcttctgtcattgtcctccccatcagtgctgtgatgctctgggaggacatcacccacgatgatgcacctttattctcacacgtgctgcaaggccagacagcacagaaatgttaatttaggcagtagatgcaaaagacctccctgcaaattaagggccttcagacctagacagactggaataggatcctcaaactggtttgatttggctgtgaccttggacaagccacctagcctctctgctttggagggtcacgaggattgacgagatgacatgtataacaaacatcctcctctttcccacttgctggattgtaagtgttcccaaagac

SEQ ID NO: 336344 - DNA, 404 bp, Homo sapiens
aatcagtgataaagtacatttaccaaaaagagaaataaaataatcagctgcttaaatggcattttccagacaatcaaagcctgcaaagctgaaatgacacaagtcactaggcttctgaggatgtgaggaaggagtgaatggttctctgtacaccgacataaaaccagcattcatcaagagaaaatagacaggtggaatatcacctgtagcaatactctagttgtcagaaataacatccctacttgaagagctagaagcccttccacttgcaggaagagtcttagccatatggtattccccaaagccacggagagaatgaaaaataaatgatgtggcaaactgtatttaaacactgctatttccagacaagttttaaaacaagcaaaactcaaaatgtgaacctt

SEQ ID NO: 336345 - DNA, 866 bp, Homo sapiens
gggggaatataaattgttaccaacactggaaaaaccattcagcattgtgtataatagttgaccttttataaagctcaaaagcaacccaaatgagataatatataggcatgaatacctagctagtagaactgtaataaaatataaacacaaaattcaaattagtaaattacctttgatctgggaaggtaagggaatgggattcagatagatatcaattactatcactgttctagtttttgaagtgaggtgaagttttttttgttttttgagatggagtctctttctgtcacccaggctagaatgcactggtgccatcttggctcactgcaacctctgcctcccaggttcaagtgattctcctgcctcagcctcccgagtagctgggactataggcacgtgccaccacgcccgggtaattttttttttgtatttttagtagagaggtggttttgtcacgttggtcaagctggtctcgaacgcctgacctcaggtgatccacccgcctcagcctcccaaagtgctggaattacaggcgtgagagaggtgaagtttttgaagtgaagtgacacactcattaaatacaatttttaaagggatatgacaagctacaaaatggaagaaaatatttgcatatgatatatctgaagaggttctagcatccaagatatataactcttacaactcaataacaacaaaaaccctaatttaaaaaatgggtgactgggcacggtagctcatgcctgtaatcctagcactttgggaggccaaggcaggcaggtcacctgaggtcaagagttagagaccagactggccaacatagtgaaaccccatctctactaaaaatgcaaacattagccaggcgtggt

SEQ ID NO: 336346 - DNA, 487 bp, Homo sapiens
agcggccgcctactactactaaattcgcggccggtcgacttttttttgtatttttagtagagaggtggttttgtcacgttggtcaagctggtctcgaacgcctgacctcaggtgatccacccgcctcagcctcccaaagtgctggaattacaggcgtgagagaggtgaagtttttgaagtgaagtgacacactcattaaatacaatttttaaagggatatgacaagctacaaaatggaagaaaatatttgcatatgatatatctgaagaggttctagcatccaagatatataactcttacaactcaataacaacaaaaaccctaatttaaaaaatgggtgactgggcacggtagctcatgcctgtaatcctagcactttgggaggccaaggcaggcaggtcacctgaggtcaagagttagagaccagactggccaacatagtgaaaccccatctctactaaaaatgcaaacattagccaggcgtggt

SEQ ID NO: 336347 - DNA, 275 bp, Homo sapiens
ggggcacaagagactatttaggggtttctttcaaagagaggaaaagatagaaaagggtctcctggaacacagcccattaaactgcagcgtgaaatctctcttaagcaaaattaaaattcctcctaaatactaaacagcagaagcggccttttcttttcccccgatttgaacctgtctgccactgcgttattgtttattctcttccatttatttggagagaaaaaaatcataaacgttcaaagactgttaccgtttcatgactacttaaatagaaa

SEQ ID NO: 336348 - DNA, 563 bp, Homo sapiens
gtaacctagagttgagagatggaggaagagatacagaatctggatggctatgctctgatcctgtaatccgactatgcctgaatgtggatctaccttccaaaggacttctccagctccatttacagtctggctcctgggcctttggatcccagcagtgtccgagcaggagctcaaaggacagccccaccatgggggatcagccctagaagctgtcactacatctccaacggacgcaactattttccaggaacaccgggggagagagccaacaacagcacagtggccccggaccgtgacccttggactgaaggaacctacagatgtggttttttttggtgacattttacatgcaactccagatttcaaactcttttggagaagcaggcaatctggcaacagtcgttttggattctcagaaggcaataaagaacagctgccaccttccgaggggcacggtggatgccctgttctgccagaattgccaacacgtttatcgtcttagacttgcccaaggtgtcgcagttagagactgcctcccttattcacgctcctgcctggtgccc

SEQ ID NO: 336349 - DNA, 780 bp, Homo sapiens
gtaacctagagttgagagatggaggaagagatacagaatctggatggctatgctctgatcctgtaatccgactatgcctgaatgtggatctaccttccaaaggtagggtgcttttcgtttgtttgagccatctggtgtcagatgttctgtcacttactaccttgttataattaatagaggagctcaaagagctataaatatctaaggaggaagagttcaggttgcaaagccttcctagacaaggttgcttcaaaggaaggtctgaaaggaagaatgggaggcaggcaggctgcaaagggagagaaaattcagggaaggagaagaccaggaacagaggcctgagatatgagagcctggtactatggactggatgcttgtggctccccccttccccctaatcgacttgttgaagcccagtccccattgtgatggcattaggtggtgtggcctctggaaagtaattaggccatgagggtgaatccctcatgaatgggattagtgtcttcatgaaaagacaggagagagcttgctttctatcctctctgccatgtgaggacacaacgagagaatggtcatctgcaaacgaggaagaggtcccttaccagagccgaccatgctggcgccctgatctgacttcccggcctctagaacagtgagaaataaatctctgttgtctaagccacccagtatatagtcatttataacagcacagagtgactgagacacctggggtgggggtgtttggggaatcatatttaattaagcctatttggttagagt

SEQ ID NO: 336350 - DNA, 394 bp, Homo sapiens
ctcggcctggagtgctgggattacaggcgtgagccaccgcgcccggcttatcttgtgtttaatcttttcctcctctctcctgctaggcgatccacacaggcctccttgctgtttctcagaggtagagctctgatctcagctttatagctactatttcttaaatgctcttcctccagttaactgtatataatggtgcctcactcattcaaatctttgctcacatatacttcagcaatgaagcttgccctgaccatcgtttttagagttaagcttctctatcccagcataaatctatcccagaataaatctcctcaaatattttacagggtttgactgtttttgtcgacataagtctaaggtttttgacctgaatgtgtggtgactcttgcttgta

SEQ ID NO: 336351 - DNA, 286 bp, Homo sapiens
cctgctggtgtcatcctcctgcatggaggccccctccccacagtgcctggagttacagcattgccctgccaagccagcagctactacccgccatcactatcaacaccttgaaaagttggtggtccagagaaaatcctcacacagcaccgcagacctttcctgaagtctccctgcctccttccctggcctcctgctgcctccttcccaggccatcacctacctgtttgctgaagagccccagtttctagcccaacagatctctccctgccatttctcccagatgcct

SEQ ID NO: 336352 - DNA, 269 bp, Homo sapiens
tcccctcattgctgaaaggaagctttctagttatagagatgcatttacagtgactttttcccaagtgaaccatctcctactttttatctgataaaatctagtacaatatttaatactcagttgtgaaaattaggtgtcttgagaagattgagaatgtgggtttgatataatgattctgaattgcttaaaaatgatttttccttttagaggttagtgggacctaattcatctaaatgacagttaataaaagttagatgaactttaattgt

SEQ ID NO: 336353 - DNA, 425 bp, Homo sapiens
agttactgtggatattgaacgagccttgcatcccaggggtaaagcccacctgaccatgatgtatcacattttaaagtgcttctggattcaatttgatggtattttgttgaggactttcaggtctatgttcatcaggactattgatctcatttttttttgtcattatgtctctcctgattttgtgtgccaagagcacacagtagagaaaggacagtcttttcaataatggtgtaaaactggcattcatatgcaaaagaaataaaattaggccttctctaactccatataaaaaaatcaactaataggccgcgcgcggtggctcacgcctgtaatcccagcactttgggaggccgaggcgggcggatcacgaggtcaggagatggagaccacagtgaaaccccgtctctactaaaaatacaaaaaaa

SEQ ID NO: 336354 - DNA, 295 bp, Homo sapiens
ccaccaacactggcccctctcttttaaagctaacaccctcaaaaatcaaacaccagatcatttaattatattgtttttaagcttgctctcccttcctccccattatattgaaaaattgtgtagcggtatcaaaacttgtttgaaagagacattcccttgcctgggcatggtggctcatgtctgtaatcctggcactttgcagggctgaggctggcagatcgcctgagcccaggagttccaagaccagcctgggcaacatggtgaaaccttgtctgtactaaaatacaaaaaaatc

SEQ ID NO: 336355 - DNA, 183 bp, Homo sapiens
caaaatatatccttgggcagcgacagagtggttgctcgctgagatgctggagacccccatcaggagcgggggttaccaagcccaaaactgctcagaacatgcccaaaagaaccagggccaggttcagaaaaatatggaccccaggacccggtgagatgacttttgaatcaaagttgaagttgg

SEQ ID NO: 336356 - DNA, 199 bp, Homo sapiens
cgactctttggatccccctgctcccggggagtacaaagaacctgcatgtcctaataggaatttgctgaaagtggcctcagacctggaggagggtatgtagaagaaaaagagcaaagcagactaggctggaggatgcggcatcctcagccagctgggcactgccagcctccagccctgccttgtctggcacttgcttttt

SEQ ID NO: 336357 - DNA, 411 bp, Homo sapiens
ctgaagacgttccctaagcatgtggccaagagactgccaccatatacacactgaagacgttccctaagcttgtggctaagggaccgccgccatgtacacacttaagacgttccctaagaatgcggccaagggaccgccaccatgtacacactgaagacgttccctaaaaatgcagggaagggacagcactaaagatgttccctaggcatgtggccaagggaatgcactgaagatgttccctaagcatgcagccaaagaactgccaccatgtatacactgaagacattccctaggaatgtgggtgagggactgctaccatgtgcacactgaagatgttccctaagaatgcaaccaagggaccactgctgtgtgcagtgaagacactccctaagtatgtggcttaagggacct

SEQ ID NO: 336358 - DNA, 139 bp, Homo sapiens
ctcagatactcctcatagtgggacattctcagattagcaaacaaaaattaaaagaagaatgattaaatctaattatattcagcatgtttttcagagtactgagtggaagagtgacttttaacttgacatctagattttt

SEQ ID NO: 336359 - DNA, 182 bp, Homo sapiens
caggagattataatctagcagcactctccttgttttcaggggtgcagtccagttagcccatgttagcactgatataaatttgggggaagacagcaattatgctcttctcactcattctgtattctaggtacccaactccagaggatctaactggccaaaagcaatggtacagctctgggcct

SEQ ID NO: 336360 - DNA, 231 bp, Homo sapiens
cattccattcaagtttccttcctgacccgtttcacctcctgcactgtgaagctggagatccccactcccaccgcccaattctgttcttggttctcttctcagtttttggtgtcctccacttccccttccgcctctagactaaacaatctggcccaaactgatgtcccagaacactcttgtgtactaaacagcttcaggtgcagctaactactgggcactttcatctctaac

SEQ ID NO: 336361 - DNA, 242 bp, Homo sapiens
gaataagatggtagaatacctgacagactgggttatgggaacatcaaaccaagcagcagatgatgatgtaaaatgtcttacaaggcatcaggtacctgaaaaagaagagatcaaggctttgaaaacgttaagtattttctaccaagctggggcttccaaagctgggaatcctattttttattatgctgcacggggcccaacagaataaaaagaccatgagaaaggatatttgcaaaacatct

SEQ ID NO: 336362 - DNA, 333 bp, Homo sapiens
gtctatcgatataacccagcaatactagacattaaaatcagatgttcatgagacccaaagccttttttaaaaactccaatgaattaattctacagacccaacttctatctttttttaatcccttttttcactttctgtattatccaaggcctgtgggacatctcaccaacagaggttattctctcattagaatacaagatctcagatgtataacgcccaccagtctcctggcttgagtttggctaattatttctgtgggattttcatttgtttggctgttaagctaggaatgttctgcttgtctgctggcatttttttttttttttttttttt

SEQ ID NO: 336363 - DNA, 391 bp, Homo sapiens
ccacggggggcgtatctttcccattggaaaagtgtggttattggaagtttcctctttttagaaagaacaggattggaggtgctctctggggtgtcctcctaccaagctgactgttgaagcccttgtggtgctcagggaggatgggtgacactcgctgttgcttcagcttcatcttgagcccacacagcatctccactacccaggtctcctcaggctcaggggcgagctccttctccggctcctccgcagattcatctgaccactccctcttccttttccagccaagggacctacatggggggctgggatctaccccaggggctgagtaaagaaaccaggccaccgtgtaatgcttctgcatctgatcaccttagaccccgacccaaaaccc

SEQ ID NO: 336364 - DNA, 111 bp, Homo sapiens
ttacagagcttgaatgaataaatatgtagctgttaatattctaaaatttcaaagtctaatgctatagtcaatgaaagcattcatgaaacattaaattgtgggcggctggct

SEQ ID NO: 336365 - DNA, 3043 bp, Homo sapiens
cgaagtgtggcggcccggcgcggcgctcccggcctgccccgcgtgcacgctgacgccgcgcagtctcgtcccctgccgccgccgtcgccgctgctgtcgccgccgccgccgccattggagtcgacgcctcctcagtgcgtccgcgtcccgggctcaccgccgctgccgcctcgccaggggcccgcgcgcccagcagccgccgccgccgcccggccggcgcccggggaattggcggcggggcccggggccgcgcgagctagggtgacaggcccggcctctaggggaggcccgagccggcgggcgccccggccccgcgtctagttgttcatgaagcatgtcggccaccagcgtggacacccagagaacaaaaggacaagataataaagtacaaaatggttcgttacatcagaaggatacagttcatgacaatgactttgagccctaccttactggacagtcaaatcagagtaacagttacccctcaatgagcgacccctacctgtccagctattacccgccgtccattggatttccttactccctcaatgaggctccgtggtctactgcaggggaccctccgattccatacctcaccacctacggacagctcagtaacggagaccatcattttatgcacgatgctgtttttgggcagcctgggggcctggggaacaacatctatcagcacaggttcaattttttccctgaaaaccctgcgttctcagcatgggggacaagtgggtctcaaggtcagcagacccagagctccgcgtatgggagcagctacacctaccccccgagctccctgggtggcacggtggttgatgggcagccaggctttcacagcgacaccctcagcaaggccccctccacccataaagcataacatggacattggcacctgggataacaaggggcctgtgccgaaggccccagtcccccagcaggcaccctctccacaggctgccccacagccccagcaggtggctcagcctctcccagcacagcccccagctttggctcaaccgcagtatcagagccctcagcagccaccccagacccgctgggttgccccacgcaacagaaacgcggcgtttgggcagagcggaggggctggcagcgatagcaactctcctggaaacgtccagcctaattctgcccccagcgtcgaatcccaccccgtccttgaaaaactgaaggctgctcacagctacaacccgaaagagtttgagtggaatctgaaaagcgggcgtgtgttcatcatcaagagctactctgaggacgacatccaccgctccattaagtactccatctggtgtagcacagagcacggcaacaagcgcctggacagcgccttccgctgcatgagcagcaaggggcccgtctacctgctcttcagcgtcaatgggagtgggcatttttgtggggtggccgagatgaagtcccccgtggactacggcaccagtgccggggtctggtctcaggacaagtggaaggggaagtttgatgtccagtggatttttgttaaggatgtacccaataaccagctccggcacatcaggctggagaataacgacaacaaaccggtcacaaactcccgggacacccaggaggtgcccttagaaaaagccaagcaagtgctgaaaattatcagttcctacaagcacacaacctccatcttcgacgactttgctcactacgagaagcgccaggaggaggaggaggtggtgcgcaaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaatgtaagtatccttaaaaacaaagcatctattttggcagaaattgtgttcttaaattcagtcatttgatattctgtgagacttcatatttctcatccctttattgctttttagcaaacataagaaaccatgagtcattttgtcatttagagtattctgataaaatctcttgaaaatactgaaatcaaaaggttaatgattttttgttcattctgatttgtcattttattatctgttatcggtctaaagtgctaatttacccatttgatttttctgctagacagataacttttaatttttcaaatttggcagacacttttttttttttttttgaaaatctttccttccagatctgttgcccactgaacagccacccgtccctcactgtcctggtgtccgattgggctggatggtgttggggcatgatgtgtggaggaactggaaggtgctttaggtctggttcagggtcgggcattctttgttgtttgcacatctttttaaattttacaccttttcttaagaattctaatgccgtcttaagtttttataccaataatgctgagctttaagtgtaggatctggtagtacagacagtgtgatggatgatgctgctggttgtaaatttcatcgtgtgtgtctaattttttttcctgttgaatgggtaaaaacaaaacaaaactttttttagaagatgaatttgctgtcatgttttgtggaatgagggaccgttgagctcactaccacctggagtttgagttgaagcatgaaaatggtgcccatgcctgacgctccagcgcctggatctgcacgtgcccttgtagaggatccttaccgtcctagagagcagacgctttctgaaaactacttgctccaaaagaccctctgagttaacgtttcagctgtatcattagacttgtatttagagcgtgtcacttcctctgaactgttactgcctgaatggagtcctggacgacattgggtttttcctctaggagaatacaagccttaataaacaatactatttagcaaa

SEQ ID NO: 336366 - DNA, 3239 bp, Homo sapiens
cgaagtgtggcggcccggcgcggcgctcccggcctgccccgcgtgcacgctgacgccgcgcagtctcgtcccctgccgccgccgtcgccgctgctgtcgccgccgccgccgccattggagtcgacgcctcctcagtgcgtccgcgtcccgggctcaccgccgctgccgcctcgccaggggcccgcgcgcccagcagccgccgccgccgcccggccggcgcccggggaattggcggcggggcccggggccgcgcgagctagggtgacaggcccggcctctaggggaggcccgagccggcgggcgccccggccccgcgtctagttgttcatgaagcatgtcggccaccagcgtggacacccagagaacaaaaggacaagataataaagtacaaaatggttcgttacatcagaaggatacagttcatgacaatgactttgagccctaccttactggacagtcaaatcagagtaacagttacccctcaatgagcgacccctacctgtccagctattacccgccgtccattggatttccttactccctcaatgaggctccgtggtctactgcaggggaccctccgattccatacctcaccacctacggacagctcagtaacggagaccatcattttatgcacgatgctgtttttgggcagcctgggggcctggggaacaacatctatcagcacaggttcaattttttccctgaaaaccctgcgttctcagcatgggggacaagtgggtctcaaggtcagcagacccagagctccgcgtatgggagcagctacacctaccccccgagctccctgggtggcacggtggttgatgggcagccaggctttcacagcgacaccctcagcaaggcccccgggatgaacagcctggagcagggcatggttggcctgaagattggggacgtcagctcctccgctgtcaagacggtgggctctgtcgtcagcagcgtggcactgactggtgtcctttctggcaacggtgggacaaatgtgaacatgccagtttcaaagccgacctcgtgggctgccattgccagcaagcctgcaaaaccacagcctaaaatgaaaacaaagagcgggcctgtcatggggggtgggctgccccctccacccataaagcataacatggacattggcacctgggataacaaggggcctgtgccgaaggccccagtcccccagcaggcaccctctccacaggctgccccacagccccagcaggtggctcagcctctcccagcacagcccccagctttggctcaaccgcagtatcagagccctcagcagccaccccagacccgctgggttgccccacgcaacagaaacgcggcgtttgggcagagcggaggggctggcagcgatagcaactctcctggaaacgtccagcctaattctgcccccagcgtcgaatcccaccccgtccttgaaaaactgaaggctgctcacagctacaacccgaaagagtttgagtggaatctgaaaagcgggcgtgtgttcatcatcaagagctactctgaggacgacatccaccgctccattaagtactccatctggtgtagcacagagcacggcaacaagcgcctggacagcgccttccgctgcatgagcagcaaggggcccgtctacctgctcttcagcgtcaatgggagtgggcatttttgtggggtggccgagatgaagtcccccgtggactacggcaccagtgccggggtctggtctcaggacaagtggaaggggaagtttgatgtccagtggatttttgttaaggatgtacccaataaccagctccggcacatcaggctggagaataacgacaacaaaccggtcacaaactcccgggacacccaggaggtgcccttagaaaaagccaagcaagtgctgaaaattatcagttcctacaagcacacaacctccatcttcgacgactttgctcactacgagaagcgccaggaggaggaggaggtggtgcgcaaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaatgtaagtatccttaaaaacaaagcatctattttggcagaaattgtgttcttaaattcagtcatttgatattctgtgagacttcatatttctcatccctttattgctttttagcaaacataagaaaccatgagtcattttgtcatttagagtattctgataaaatctcttgaaaatactgaaatcaaaaggttaatgattttttgttcattctgatttgtcattttattatctgttatcggtctaaagtgctaatttacccatttgatttttctgctagacagataacttttaatttttcaaatttggcagacactttttttttttttttgtcctggtgtccgattgggctggatggtgttggggcatgatgtgtggaggaactggaaggtgctttaggtctggttcagggtcgggcattctttgttgtttgcacatctttttaaattttacaccttttcttaagaattctaatgccgtcttaagtttttataccaataatgctgagctttaagtgtaggatctggtagtacagacagtgtgatggatgatgctgctggttgtaaatttcatcgtgtgtgtctaattttttttcctgttgaatgggtaaaaacaaaacaaaactttttttagaagatgaatttgctgtcatgttttgtggaatgagggaccgttgagctcactaccacctggagtttgagttgaagcatgaaaatggtgcccatgcctgacgctccagcgcctggatctgcacgtgcccttgtagaggatccttaccgtcctagagagcagacgctttctgaaaactacttgctccaaaagaccctctgagttaacgtttcagctgtatcattagacttgtatttagagcgtgtcacttcctctgaactgttactgcctgaatggagtcctggacgacattgggtttttcctctaggagaatacaagccttaataaacaatactatttagcaaa

SEQ ID NO: 336367 - DNA, 1718 bp, Homo sapiens
cgaagtgtggcggcccggcgcggcgctcccggcctgccccgcgtgcacgctgacgccgcgcagtctcgtcccctgccgccgccgtcgccgctgctgtcgccgccgccgccgccattggagtcgacgcctcctcagtgcgtccgcgtcccgggctcaccgccgctgccgcctcgccaggggcccgcgcgcccagcagccgccgccgccgcccggccggcgcccggggaattggcggcggggcccggggccgcgcgagctagggtgacaggcccggcctctaggggaggcccgagccggcgggcgccccggccccgcgtctagttgttcatgaagcatgtcggccaccagcgtggacacccagagaacaaaaggacaagataataaagtacaaaatggttcgttacatcagaaggatacagttcatgacaatgactttgagccctaccttactggacagtcaaatcaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaatgtaagtatccttaaaaacaaagcatctattttggcagaaattgtgttcttaaattcagtcatttgatattctgtgagacttcatatttctcatccctttattgctttttagcaaacataagaaaccatgagtcattttgtcatttagagtattctgataaaatctcttgaaaatactgaaatcaaaaggttaatgattttttgttcattctgatttgtcattttattatctgttatcggtctaaagtgctaatttacccatttgatttttctgctagacagataacttttaatttttcaaatttggcagacactttttttttttttttgtcctggtgtccgattgggctggatggtgttggggcatgatgtgtggaggaactggaaggtgctttaggtctggttcagggtcgggcattctttgttgtttgcacatctttttaaattttacaccttttcttaagaattctaatgccgtcttaagtttttataccaataatgctgagctttaagtgtaggatctggtagtacagacagtgtgatggatgatgctgctggttgtaaatttcatcgtgtgtgtctaattttttttcctgttgaatgggtaaaaacaaaacaaaactttttttagaagatgaatttgctgtcatgttttgtggaatgagggaccgttgagctcactaccacctggagtttgagttgaagcatgaaaatggtgcccatgcctgacgctccagcgcctggatctgcacgtgcccttgtagaggatccttaccgtcctagagagcagacgctttctgaaaactacttgctccaaaagaccctctgagttaacgtttcagctgtatcattagacttgtatttagagcgtgtcacttcctctgaactgttactgcctgaatggagtcctggacgacattgggtttttcctctaggagaatacaagccttaataaacaatactatttagcaaa

SEQ ID NO: 336368 - DNA, 3240 bp, Homo sapiens
cgaagtgtggcggcccggcgcggcgctcccggcctgccccgcgtgcacgctgacgccgcgcagtctcgtcccctgccgccgccgtcgccgctgctgtcgccgccgccgccgccattggagtcgacgcctcctcagtgcgtccgcgtcccgggctcaccgccgctgccgcctcgccaggggcccgcgcgcccagcagccgccgccgccgcccggccggcgcccggggaattggcggcggggcccggggccgcgcgagctagggtgacaggcccggcctctaggggaggcccgagccggcgggcgccccggccccgcgtctagttgttcatgaagcatgtcggccaccagcgtggacacccagagaacaaaaggacaagataataaagtacaaaatggttcgttacatcagaaggatacagttcatgacaatgactttgagccctaccttactggacagtcaaatcagagtaacagttacccctcaatgagcgacccctacctgtccagctattacccgccgtccattggatttccttactccctcaatgaggctccgtggtctactgcaggggaccctccgattccatacctcaccacctacggacagctcagtaacggagaccatcattttatgcacgatgctgtttttgggcagcctgggggcctggggaacaacatctatcagcacaggttcaattttttccctgaaaaccctgcgttctcagcatgggggacaagtgggtctcaaggtcagcagacccagagctccgcgtatgggagcagctacacctaccccccgagctccctgggtggcacggtggttgatgggcagccaggctttcacagcgacaccctcagcaaggcccccgggatgaacagcctggagcagggcatggttggcctgaagattggggacgtcagctcctccgctgtcaagacggtgggctctgtcgtcagcagcgtggcactgactggtgtcctttctggcaacggtgggacaaatgtgaacatgccagtttcaaagccgacctcgtgggctgccattgccagcaagcctgcaaaaccacagcctaaaatgaaaacaaagagcgggcctgtcatggggggtgggctgccccctccacccataaagcataacatggacattggcacctgggataacaaggggcctgtgccgaaggccccagtcccccagcaggcaccctctccacaggctgccccacagccccagcaggtggctcagcctctcccagcacagcccccagctttggctcaaccgcagtatcagagccctcagcagccaccccagacccgctgggttgccccacgcaacagaaacgcggcgtttgggcagagcggaggggctggcagcgatagcaactctcctggaaacgtccagcctaattctgcccccagcgtcgaatcccaccccgtccttgaaaaactgaaggctgctcacagctacaacccgaaagagtttgagtggaatctgaaaagcgggcgtgtgttcatcatcaagagctactctgaggacgacatccaccgctccattaagtactccatctggtgtagcacagagcacggcaacaagcgcctggacagcgccttccgctgcatgagcagcaaggggcccgtctacctgctcttcagcgtcaatgggagtgggcatttttgtggggtggccgagatgaagtcccccgtggactacggcaccagtgccggggtctggtctcaggacaagtggaaggggaagtttgatgtccagtggatttttgttaaggatgtacccaataaccagctccggcacatcaggctggagaataacgacaacaaaccggtcacaaactcccgggacacccaggaggtgcccttagaaaaagccaagcaagtgctgaaaattatcagttcctacaagcacacaacctccatcttcgacgactttgctcactacgagaagcgccaggaggaggaggaggtggtgcgcaaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaatgtaagtatccttaaaaacaaagcatctattttggcagaaattgtgttcttaaattcagtcatttgatattctgtgagacttcatatttctcatccctttattgctttttagcaaacataagaaaccatgagtcattttgtcatttagagtattctgataaaatctcttgaaaatactgaaatcaaaaggttaatgattttttgttcattctgatttgtcattttattatctgttatcggtctaaagtgctaatttacccatttgatttttctgctagacagataacttttaatttttcaaatttggcagacacttttttttttttttttgaaaatctttccttccagatctgttgcccactgaacagccacccgtccctcactgtcctggtgtccgattgggctggatggtgttggggcatgatgtgtggaggaactggaaggtgctttaggtctggttcagggtcgggcattctttgttgtttgcacatctttttaaattttacaccttttcttaagaattctaatgccgtcttaagtttttataccaataatgctgagctttaagtgtaggatctggtagtacagacagtgtgatggatgatgctgctggttgtaaatttcatcgtgtgtgtctaattttttttcctgttgaatgggtaaaaacaaaacaaaactttttttagaagatgaatttgctgtcatgttttgtggaatgagggaccgttgagctcactaccacctggagtttgagttgaagcatgaaggatccttaccgtcctagagagcagacgctttctgaaaactacttgctccaaaagaccctctgagttaacgtttcagctgtatcattagacttgtatttagagcgtgtcacttcctctgaactgttactgcctgaatggagtcctggacgacattgggtttttcctctaggagaatacaagccttaataaacaatactatttagcaaa

SEQ ID NO: 336369 - DNA, 2609 bp, Homo sapiens
cgaagtgtggcggcccggcgcggcgctcccggcctgccccgcgtgcacgctgacgccgcgcagtctcgtcccctgccgccgccgtcgccgctgctgtcgccgccgccgccgccattggagtcgacgcctcctcagtgcgtccgcgtcccgggctcaccgccgctgccgcctcgccaggggcccgcgcgcccagcagccgccgccgccgcccggccggcgcccggggaattggcggcggggcccggggccgcgcgagctagggtgacaggcccggcctctaggggaggcccgagccggcgggcgccccggccccgcgtctagttgttcatgaagcatgtcggccaccagcgtggacacccagagaacaaaaggacaagataataaagtacaaaatggttcgttacatcagaaggatacagttcatgacaatgactttgagccctaccttactggacagtcaaatcagagtaacagttacccctcaatgagcgacccctacctgtccagctattacccgccgtccattggatttccttactccctcaatgaggctccgtggtctactgcaggggaccctccgattccatacctcaccacctacggacagctcagtaacggagaccatcattttatgcacgatgctgtttttgggcagcctgggggcctggggaacaacatctatcagcacaggttcaattttttccctgaaaaccctgcgttctcagcatgggggacaagtgggtctcaaggtcagcagacccagagctccgcgtatgggagcagctacacctaccccccgagctccctgggtggcacggtggttgatgggcagccaggctttcacagcgacaccctcagcaaggcccccgggatgaacagcctggagcagggcatggttggcctgaagattggggacgtcagctcctccgctgtcaagacggtgggctctgtcgtcagcagcgtggcactgactggtgtcctttctggcaacggtgggacaaatgtgaacatgccagtttcaaagccgacctcgtgggctgccattgccagcaagcctgcaaaaccacagcctaaaatgaaaacaaagagcgggcctgtcatggggggtgggctgccccctccacccataaagcataacatggacattggcacctgggataacaaggggcctgtgccgaaggccccagtcccccagcaggcaccctctccacaggctgccccacagccccagcaggtggctcagcctctcccagcacagcccccagctttggctcaaccgcagtatcagagccctcagcagccaccccagacccgctgggttgccccacgcaacagaaacgcggcgtttgggcagagcggaggggctggcagcgatagcaactctcctggaaacgtccagcctaattctgcccccagcgtcgaatcccaccccgtccttgaaaaactgaaggctgctcacagctacaacccgaaagagtttgagtggaatctgaaaagcgggcgtgtgttcatcatcaagagctactctgaggacgacatccaccgctccattaagtactccatctggtgtagcacagagcacggcaacaagcgcctggacagcgccttccgctgcatgagcagcaaggggcccgtctacctgctcttcagcgtcaatgggagtgggcatttttgtggggtggccgagatgaagtcccccgtggactacggcaccagtgccggggtctggtctcaggacaagtggaaggggaagtttgatgtccagtggatttttgttaaggatgtacccaataaccagctccggcacatcaggctggagaataacgacaacaaaccggtcacaaactcccgggacacccaggaggtgcccttagaaaaagccaagcaagtgctgaaaattatcagttcctacaagcacacaacctccatcttcgacgactttgctcactacgagaagcgccaggaggaggaggaggtggtgcgcaaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaataagatgaatttgctgtcatgttttgtggaatgagggaccgttgagctcactaccacctggagtttgagttgaagcatgaaaatggtgcccatgcctgacgctccagcgcctggatctgcacgtgcccttgtagaggatccttaccgtcctagagagcagacgctttctgaaaactacttgctccaaaagaccctctgagttaacgtttcagctgtatcattagacttgtatttagagcgtgtcacttcctctgaactgttactgcctgaatggagtcctggacgacattgggtttttcctctaggagaatacaagccttaataaacaatactatttagcaaa

SEQ ID NO: 336370 - DNA, 1335 bp, Homo sapiens
cgaagtgtggcggcccggcgcggcgctcccggcctgccccgcgtgcacgctgacgccgcgcagtctcgtcccctgccgccgccgtcgccgctgctgtcgccgccgccgccgccattggagtcgacgcctcctcagtgcgtccgcgtcccgggctcaccgccgctgccgcctcgccaggggcccgcgcgcccagcagccgccgccgccgcccggccggcgcccggggaattggcggcggggcccggggccgcgcgagctagggtgacaggcccggcctctaggggaggcccgagccggcgggcgccccggccccgcgtctagttgttcatgaagcatgtcggccaccagcgtggacacccagagaacaaaaggacaagataataaagtacaaaatggttcgttacatcagaaggatacagttcatgacaatgactttgagccctaccttactggacagtcaaatcagagtaacagttacccctcaatgagcgacccctacctgtccagctattacccgccgtccattggatttccttactccctcaatgaggctccgtggtctactgcaggggaccctccgattccatacctcaccacctacggacagctcagtaacggagaccatcattttatgcacgatgctgtttttgggcagcctgggggcctggggaacaacatctatcagcacaggttcaattttttccctgaaaaccctgcgttctcagcatgggggacaagtgggtctcaaggtcagcagacccagagctccgcgtatgggagcagctacacctaccccccgagctccctgggtggcacggtggttgatgggcagccaggctttcacagcgacaccctcagcaaggcccccgggatgaacagcgctggagaataacgacaacaaaccggtcacaaactcccgggacacccaggaggtgcccttagaaaaagccaagcaagtgctgaaaattatcagttcctacaagcacacaacctccatcttcgacgactttgctcactacgagaagcgccaggaggaggaggaggtggtgcgcaaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaat

SEQ ID NO: 336371 - DNA, 3294 bp, Homo sapiens
cgaagtgtggcggcccggcgcggcgctcccggcctgccccgcgtgcacgctgacgccgcgcagtctcgtcccctgccgccgccgtcgccgctgctgtcgccgccgccgccgccattggagtcgacgcctcctcagtgcgtccgcgtcccgggctcaccgccgctgccgcctcgccaggggcccgcgcgcccagcagccgccgccgccgcccggccggcgcccggggaattggcggcggggcccggggccgcgcgagctagggtgacaggcccggcctctaggggaggcccgagccggcgggcgccccggccccgcgtctagttgttcatgaagcatgtcggccaccagcgtggacacccagagaacaaaaggacaagataataaagtacaaaatggttcgttacatcagaaggatacagttcatgacaatgactttgagccctaccttactggacagtcaaatcagagtaacagttacccctcaatgagcgacccctacctgtccagctattacccgccgtccattggatttccttactccctcaatgaggctccgtggtctactgcaggggaccctccgattccatacctcaccacctacggacagctcagtaacggagaccatcattttatgcacgatgctgtttttgggcagcctgggggcctggggaacaacatctatcagcacaggttcaattttttccctgaaaaccctgcgttctcagcatgggggacaagtgggtctcaaggtcagcagacccagagctccgcgtatgggagcagctacacctaccccccgagctccctgggtggcacggtggttgatgggcagccaggctttcacagcgacaccctcagcaaggcccccgggatgaacagcctggagcagggcatggttggcctgaagattggggacgtcagctcctccgctgtcaagacggtgggctctgtcgtcagcagcgtggcactgactggtgtcctttctggcaacggtgggacaaatgtgaacatgccagtttcaaagccgacctcgtgggctgccattgccagcaagcctgcaaaaccacagcctaaaatgaaaacaaagagcgggcctgtcatggggggtgggctgccccctccacccataaagcataacatggacattggcacctgggataacaaggggcctgtgccgaaggccccagtcccccagcaggcaccctctccacaggctgccccacagccccagcaggtggctcagcctctcccagcacagcccccagctttggctcaaccgcagtatcagagccctcagcagccaccccagacccgctgggttgccccacgcaacagaaacgcggcgtttgggcagagcggaggggctggcagcgatagcaactctcctggaaacgtccagcctaattctgcccccagcgtcgaatcccaccccgtccttgaaaaactgaaggctgctcacagctacaacccgaaagagtttgagtggaatctgaaaagcgggcgtgtgttcatcatcaagagctactctgaggacgacatccaccgctccattaagtactccatctggtgtagcacagagcacggcaacaagcgcctggacagcgccttccgctgcatgagcagcaaggggcccgtctacctgctcttcagcgtcaatgggagtgggcatttttgtggggtggccgagatgaagtcccccgtggactacggcaccagtgccggggtctggtctcaggacaagtggaaggggaagtttgatgtccagtggatttttgttaaggatgtacccaataaccagctccggcacatcaggctggagaataacgacaacaaaccggtcacaaactcccgggacacccaggaggtgcccttagaaaaagccaagcaagtgctgaaaattatcagttcctacaagcacacaacctccatcttcgacgactttgctcactacgagaagcgccaggaggaggaggaggtggtgcgcaaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaatgtaagtatccttaaaaacaaagcatctattttggcagaaattgtgttcttaaattcagtcatttgatattctgtgagacttcatatttctcatccctttattgctttttagcaaacataagaaaccatgagtcattttgtcatttagagtattctgataaaatctcttgaaaatactgaaatcaaaaggttaatgattttttgttcattctgatttgtcattttattatctgttatcggtctaaagtgctaatttacccatttgatttttctgctagacagataacttttaatttttcaaatttggcagacacttttttttttttttttgaaaatctttccttccagatctgttgcccactgaacagccacccgtccctcactgtcctggtgtccgattgggctggatggtgttggggcatgatgtgtggaggaactggaaggtgctttaggtctggttcagggtcgggcattctttgttgtttgcacatctttttaaattttacaccttttcttaagaattctaatgccgtcttaagtttttataccaataatgctgagctttaagtgtaggatctggtagtacagacagtgtgatggatgatgctgctggttgtaaatttcatcgtgtgtgtctaattttttttcctgttgaatgggtaaaaacaaaacaaaactttttttagaagatgaatttgctgtcatgttttgtggaatgagggaccgttgagctcactaccacctggagtttgagttgaagcatgaaaatggtgcccatgcctgacgctccagcgcctggatctgcacgtgcccttgtagaggatccttaccgtcctagagagcagacgctttctgaaaactacttgctccaaaagaccctctgagttaacgtttcagctgtatcattagacttgtatttagagcgtgtcacttcctctgaactgttactgcctgaatggagtcctggacgacattgggtttttcctctaggagaatacaagccttaataaacaatactatttagcaaa

SEQ ID NO: 336372 - DNA, 2706 bp, Homo sapiens
tgaaaacaaagagcgggcctgtcatggggggtgggctgccccctccacccataaagcataacatggacattggcacctggggaacaacatctatcagcacaggttcaattttttccctgaaaaccctgcgttctcagcatgggggacaagtgggtctcaaggtcagcagacccagagctccgcgtatgggagcagctacacctaccccccgagctccctgggtggcacggtggttgatgggcagccaggctttcacagcgacaccctcagcaaggcccccgggatgaacagcctggagcagggcatggttggcctgaagattggggacgtcagctcctccgctgtcaagacggtgggctctgtcgtcagcagcgtggcactgactggtgtcctttctggcaacggtgggacaaatgtgaacatgccagtttcaaagccgacctcgtgggctgccattgccagcaagcctgcaaaaccacagcctaaaatgaaaacaaagagcgggcctgtcatggggggtgggctgccccctccacccataaagcataacatggacattggcacctgggataacaaggggcctgtgccgaaggccccagtcccccagcaggcaccctctccacaggctgccccacagccccagcaggtggctcagcctctcccagcacagcccccagctttggctcaaccgcagtatcagagccctcagcagccaccccagacccgctgggttgccccacgcaacagaaacgcggcgtttgggcagagcggaggggctggcagcgatagcaactctcctggaaacgtccagcctaattctgcccccagcgtcgaatcccaccccgtccttgaaaaactgaaggctgctcacagctacaacccgaaagagtttgagtggaatctgaaaagcgggcgtgtgttcatcatcaagagctactctgaggacgacatccaccgctccattaagtactccatctggtgtagcacagagcacggcaacaagcgcctggacagcgccttccgctgcatgagcagcaaggggcccgtctacctgctcttcagcgtcaatgggagtgggcatttttgtggggtggccgagatgaagtcccccgtggactacggcaccagtgccggggtctggtctcaggacaagtggaaggggaagtttgatgtccagtggatttttgttaaggatgtacccaataaccagctccggcacatcaggctggagaataacgacaacaaaccggtcacaaactcccgggacacccaggaggtgcccttagaaaaagccaagcaagtgctgaaaattatcagttcctacaagcacacaacctccatcttcgacgactttgctcactacgagaagcgccaggaggaggaggaggtggtgcgcaaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaatgtaagtatccttaaaaacaaagcatctattttggcagaaattgtgttcttaaattcagtcatttgatattctgtgagacttcatatttctcatccctttattgctttttagcaaacataagaaaccatgagtcattttgtcatttagagtattctgataaaatctcttgaaaatactgaaatcaaaaggttaatgattttttgttcattctgatttgtcattttattatctgttatcggtctaaagtgctaatttacccatttgatttttctgctagacagataacttttaatttttcaaatttggcagacacttttttttttttttttgaaaatctttccttccagatctgttgcccactgaacagccacccgtccctcactgtcctggtgtccgattgggctggatggtgttggggcatgatgtgtggaggaactggaaggtgctttaggtctggttcagggtcgggcattctttgttgtttgcacatctttttaaattttacaccttttcttaagaattctaatgccgtcttaagtttttataccaataatgctgagctttaagtgtaggatctggtagtacagacagtgtgatggatgatgctgctggttgtaaatttcatcgtgtgtgtctaattttttttcctgttgaatgggtaaaaacaaaacaaaactttttttagaagatgaatttgctgtcatgttttgtggaatgagggaccgttgagctcactaccacctggagtttgagttgaagcatgaaaatggtgcccatgcctgacgctccagcgcctggatctgcacgtgcccttgtagaggatccttaccgtcctagagagcagacgctttctgaaaactacttgctccaaaagaccctctgagttaacgtttcagctgtatcattagacttgtatttagagcgtgtcacttcctctgaactgttactgcctgaatggagtcctggacgacattgggtttttcctctaggagaatacaagccttaataaacaatactatttagcaaa

SEQ ID NO: 336373 - DNA, 1773 bp, Homo sapiens
cgaagtgtggcggcccggcgcggcgctcccggcctgccccgcgtgcacgctgacgccgcgcagtctcgtcccctgccgccgccgtcgccgctgctgtcgccgccgccgccgccattggagtcgacgcctcctcagtgcgtccgcgtcccgggctcaccgccgctgccgcctcgccaggggcccgcgcgcccagcagccgccgccgccgcccggccggcgcccggggaattggcggcggggcccggggccgcgcgagctagggtgacaggcccggcctctaggggaggcccgagccggcgggcgccccggccccgcgtctagttgttcatgaagcatgtcggccaccagcgtggacacccagagaacaaaaggacaagataataaagtacaaaatggttcgttacatcagaaggatacagttcatgacaatgactttgagccctaccttactggacagtcaaatcaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaatgtaagtatccttaaaaacaaagcatctattttggcagaaattgtgttcttaaattcagtcatttgatattctgtgagacttcatatttctcatccctttattgctttttagcaaacataagaaaccatgagtcattttgtcatttagagtattctgataaaatctcttgaaaatactgaaatcaaaaggttaatgattttttgttcattctgatttgtcattttattatctgttatcggtctaaagtgctaatttacccatttgatttttctgctagacagataacttttaatttttcaaatttggcagacacttttttttttttttttgaaaatctttccttccagatctgttgcccactgaacagccacccgtccctcactgtcctggtgtccgattgggctggatggtgttggggcatgatgtgtggaggaactggaaggtgctttaggtctggttcagggtcgggcattctttgttgtttgcacatctttttaaattttacaccttttcttaagaattctaatgccgtcttaagtttttataccaataatgctgagctttaagtgtaggatctggtagtacagacagtgtgatggatgatgctgctggttgtaaatttcatcgtgtgtgtctaattttttttcctgttgaatgggtaaaaacaaaacaaaactttttttagaagatgaatttgctgtcatgttttgtggaatgagggaccgttgagctcactaccacctggagtttgagttgaagcatgaaaatggtgcccatgcctgacgctccagcgcctggatctgcacgtgcccttgtagaggatccttaccgtcctagagagcagacgctttctgaaaactacttgctccaaaagaccctctgagttaacgtttcagctgtatcattagacttgtatttagagcgtgtcacttcctctgaactgttactgcctgaatggagtcctggacgacattgggtttttcctctaggagaatacaagccttaataaacaatactatttagcaaa

SEQ ID NO: 336374 - DNA, 3104 bp, Homo sapiens
  misc_feature (3104)..(3104): n is a, c, g, or t
cgaagtgtggcggcccggcgcggcgctcccggcctgccccgcgtgcacgctgacgccgcgcagtctcgtcccctgccgccgccgtcgccgctgctgtcgccgccgccgccgccattggagtcgacgcctcctcagtgcgtccgcgtcccgggctcaccgccgctgccgcctcgccaggggcccgcgcgcccagcagccgccgccgccgcccggccggcgcccggggaattggcggcggggcccggggccgcgcgagctagggtgacaggcccggcctctaggggaggcccgagccggcgggcgccccggccccgcgtctagttgttcatgaagcatgtcggccaccagcgtggacacccagagaacaaaaggacaagataataaagtacaaaatggttcgttacatcagaaggatacagttcatgacaatgactttgagccctaccttactggacagtcaaatcagagtaacagttacccctcaatgagcgacccctacctgtccagctattacccgccgtccattggatttccttactccctcaatgaggctccgtggtctactgcaggggaccctccgattccatacctcaccacctacggacagctcagtaacggagaccatcattttatgcacgatgctgtttttgggcagcctgggggcctggggaacaacatctatcagcacaggttcaattttttccctgaaaaccctgcgttctcagcatgggggacaagtgggtctcaaggtcagcagacccagagctccgcgtatgggagcagctacacctaccccccgagctccctgggtggcacggtggttgatgggcagccaggctttcacagcgacaccctcagcaaggcccccgggatgaacagcctggagcagggcatggttggcctgaagattggggacgtcagctcctccgctgtcaagacggtgggctctgtcgtcagcagcgtggcactgactggtgtcctttctggcaacggtgggacaaatgtgaacatgccagtttcaaagccgacctcgtgggctgccattgccagcaagcctgcaaaaccacagcctaaaatgaaaacaaagagcgggcctgtcatggggggtgggctgccccctccacccataaagcataacatggacattggcacctgggataacaaggggcctgtgccgaaggccccagtcccccagcaggcaccctctccacaggctgccccacagccccagcaggtggctcagcctctcccagcacagcccccagctttggctcaaccgcagtatcagagccctcagcagccaccccagacccgctgggttgccccacgcaacagaaacgcggcgtttgggcagagcggaggggctggcagcgatagcaactctcctggaaacgtccagcctaattctgcccccagcgtcgaatcccaccccgtccttgaaaaactgaaggctgctcacagctacaacccgaaagagtttgagtggaatctgaaaagcgggcgtgtgttcatcatcaagagctactctgaggacgacatccaccgctccattaagtactccatctggtgtagcacagagcacggcaacaagcgcctggacagcgccttccgctgcatgagcagcaaggggcccgtctacctgctcttcagcgtcaatgggagtgggcatttttgtggggtggccgagatgaagtcccccgtggactacggcaccagtgccggggtctggtctcaggacaagtggaaggggaagtttgatgtccagtggatttttgttaaggatgtacccaataaccagctccggcacatcaggctggagaataacgacaacaaaccggtcacaaactcccgggacacccaggaggtgcccttagaaaaagccaagcaagtgctgaaaattatcagttcctacaagcacacaacctccatcttcgacgactttgctcactacgagaagcgccaggaggaggaggaggtggtgcgcaaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaatgtaagtatccttaaaaacaaagcatctattttggcagaaattgtgttcttaaattcagtcatttgatattctgtgagacttcatatttctcatccctttattgctttttagcaaacataagaaaccatgagtcattttgtcatttagagtattctgataaaatctcttgaaaatactgaaatcaaaaggttaatgattttttgttcattctgatttgtcattttattatctgttatcggtctaaagtgctaatttacccatttgatttttctgctagacagataacttttaatttttcaaatttggcagacacttttttttttttttttgaaaatctttccttccagatctgttgcccactgaacagccacccgtccctcactgtcctggtgtccgattgggctggatggtgttggggcatgatgtgtggaggaactggaaggtgctttaggtctggttcagggtcgggcattctttgttgtttgcacatctttttaaattttacaccttttcttaagaattctaatgccgtcttaagtttttataccaataatgctgagctttaagtgtaggatctggtagtacagacagtgtgatggatgatgctgctggttgtaaatttcatcgtgtgtgtctaattttttttcctgttgaatgggtgaaggacccgtgagctactaccacctgaagttgagtgaagcataaatggtgccatgcctgacttcaaggcttgacttacgtgccttgaaagatctatacgctataaggaaccttctgaaactactgtcaaagactcttggtaacgttactggtcattaacttgattaaaggggcccn

SEQ ID NO: 336375 - DNA, 2267 bp, Homo sapiens
cgaagtgtggcggcccggcgcggcgctcccggcctgccccgcgtgcacgctgacgccgcgcagtctcgtcccctgccgccgccgtcgccgctgctgtcgccgccgccgccgccattggagtcgacgcctcctcagtgcgtccgcgtcccgggctcaccgccgctgccgcctcgccaggggcccgcgcgcccagcagccgccgccgccgcccggccggcgcccggggaattggcggcggggcccggggccgcgcgagctagggtgacaggcccggcctctaggggaggcccgagccggcgggcgccccggccccgcgtctagttgttcatgaagcatgtcggccaccagcgtggacacccagagaacaaaaggacaagataataaagtacaaaatggttcgttacatcagaaggatacagttcatgacaatgactttgagccctaccttactggacagtcaaatcagagtaacagttacccctcaatgagcgacccctacctgtccagctattacccgccgtccattggatttccttactccctcaatgaggctccgtggtctactgcaggggaccctccgattccatacctcaccacctacggacagctcagtaacggagaccatcattttatgcacgatgctgtttttgggcagcctgggggcctggggaacaacatctatcagcacaggttcaattttttccctgaaaaccctgcgttctcagcatgggggacaagtgggtctcaaggtcagcagacccagagctccgcgtatgggagcagctacacctaccccccgagctccctgggtggcacggtggttgatgggcagccaggctttcacagcgacaccctcagcaaggcccccgggatgaacagcctggagcagggcatggttggcctgaagattggggacgtcagctcctccgctgtcaagacggtgggctctgtcgtcagcagcgtggcactgactggtgtcctttctggcaacggtgggacaaatgtgaacatgccagtttcaaagccgacctcgtgggctgccattgccagcaagcctgcaaaaccacagcctaaaatgaaaacaaagagcgggcctgtcatggggggtgggctgccccctccacccataaagcataacatggacattggcacctgggataacaaggggcctgtgccgaaggccccagtcccccagcaggcaccctctccacaggctgccccacagccccagcaggtggctcagcctctcccagcacagcccccagctttggctcaaccgcagtatcagagccctcagcagccaccccagacccgctgggttgccccacgcaacagaaacgcggcgtttgggcagagcggaggggctggcagcgatagcaactctcctggaaacgtccagcctaattctgcccccagcgtcgaatcccaccccgtccttgaaaaactgaaggctgctcacagctacaacccgaaagagtttgagtggaatctgaaaagcgggcgtgtgttcatcatcaagagctactctgaggacgacatccaccgctccattaagtactccatctggtgtagcacagagcacggcaacaagcgcctggacagcgccttccgctgcatgagcagcaaggggcccgtctacctgctcttcagcgtcaatgggagtgggcatttttgtggggtggccgagatgaagtcccccgtggactacggcaccagtgccggggtctggtctcaggacaagtggaaggggaagtttgatgtccagtggatttttgttaaggatgtacccaataaccagctccggcacatcaggctggagaataacgacaacaaaccggtcacaaactcccgggacacccaggaggtgcccttagaaaaagccaagcaagtgctgaaaattatcagttcctacaagcacacaacctccatcttcgacgactttgctcactacgagaagcgccaggaggaggaggaggtggtgcgcaaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaat

SEQ ID NO: 336376 - DNA, 307 bp, Homo sapiens
gctgggaagggaaggagccacacaaggaaggacgcagtatccagcaaaacccaaagggaaactggcaccatcccacgggggagcagtgcagacacgcaaacacatctccacaccgtccccatcagtggcagggctgctgtgccatttacacctgtcagtcacgggttaagtaagcggggaaatgctgaatacccggcatgtacatcacatagtgggctatactgaaaatctctcagggaacagatccaggaataaggacatcatttgactgtcaaaagggtctttgaaaactatgaatggaaagtag

SEQ ID NO: 336377 - DNA, 433 bp, Homo sapiens
catccatcttctgggctggcccaggacacgtgcccccatcccagcctccaagaatctgggaatgtccttagcagactgggctggcatgtggcctctgcccggggagcagaggtggctccccaaaggcttcctgagaagtggtggaggagactcagcttccccgtccagtcttttgggaggcccaggctggaggatcacttgagcccaggagttcaagaccagcctgggcaacatggtgagaccctgtccctaaaaaaatttaaattagccaggagtggtggtgtgcacctgtagtcccagctactcaggaggctgaggcgggaggatcacttgggcatggagattgaggctgcagtgagctgtgatccagcctggacaacagagcaagaccctgcctctaaaaaaccaagttaatggtgggtcagaacataag

SEQ ID NO: 336378 - DNA, 259 bp, Homo sapiens
ccacaattcttacacaaaaataactaaaggactcactcaagccaggttctaaatattttatactagaactgccttttttttcttgtcctttgtaggaacatggatgaagctggaaaccatcattctgagcaaactattgcaaggacagaaaaccaaacaccgcatgttctcactcataggtgggaactgaacaatgagaacacctggacacaaggtgggcaacatcacacaccggggcctgttgtgggatggggggaga

SEQ ID NO: 336379 - DNA, 364 bp, Homo sapiens
cctactaccacagctccccgtacgccaaggctgctttgctgccaatctcaactaatgaactcagggttgtgtttcctgacacattccacaggcacagcaaggattccagagccccactttgtttctgaggaaggaaaggaagcatgcaggccagattcacatttgtttctccattactttagcaatcattaaacaagtgtacactacaatcccacaggaaacaggaagatatgtttggggaaggttggtaaaagttgtgtcccacatcaaaggaaagttgtcttcgttcatactgctcacatctggagcacccccacgcactgggtgaaacaggaccatcatggtggaacatgctctctccttt

SEQ ID NO: 336380 - DNA, 834 bp, Homo sapiens
aaatgaaatcctcctccagcagcacatttgcaaattccagaggggacatgatatactatggaagttgacatagaactccgcacttaggtgggcgattgttagcagtacagcatggtggttaagaacatggactttggagccagatggccaaatcatggccctacccttgtgaaactgaggtaaagaagaaggaagaaagaatttggaatgggtgtttactgagcaaatttattgtacctgccacagagagctgaggtgacagcacaaaatcaagtacaaaacaaagtggttgattttagatgatgactgtatcagtgggactatgtaagttcagtacttggcatagggcctggtttctccttgtggaaggcagtggttctccatcacaacaccattcttgccagcaacccttggctccctaggtaatccaaagagcctggatttccattcatttacctatgcaactctgcatgaacctgaagaacaatcatcaagcggatggattcaaactgcatctccatgtatctaacattcagcattgctatttgttttatgtaagcactgaactcaaaaacctagttatttatcctaagtatccctaaatttctgctaataatcatttgtgtatatggatgagtgaatcataatttggctcagccctatttctttttcaaatccatatcaccagtcatcaataataaataaccaagttagcagtttctaatgaatcaaaaatcctattacattccatagttaagccaaattaagattccttatggaaacaagaactctactggttatcttaaaatctctccttcctccttagataaccct

SEQ ID NO: 336381 - DNA, 269 bp, Homo sapiens
aaaaaaggattgaaatagagcagttctacttttctaccctgagggagtatgggaatttgtatttgacgcaagtggtcattgttcaataagtggataacatttaagcatcttggcaggagtgcatagctggagttagcactgttcatggcttgaatagatctccagaccctcaaagtatgtgggtatagttgtgtttgcattgaattaataagttcagacagttttatttatttatttttgagacagagtcttgctttgtcgcccaggct

SEQ ID NO: 336382 - DNA, 287 bp, Homo sapiens
ccaggcttgttttttaaacaaagactttcttacctgtgattattagacctaaaaccaatatacctttatcttttccaagttccctctttcccctccatgttacattttaagcatctatttttagtgatagctttcaacattggccttttgagccatcgcccagtatgcattacaatttccacaaacacttttgccatttgatgtcgtaaattctttcaaaatggtttttaggtaatgattatgtacatcatttaagtttttccgaataaatgctgattataattgtt

SEQ ID NO: 336383 - DNA, 394 bp, Homo sapiens
agtggtttgcaaaaaacttcttttctgagcacttcaacaaaggttgccgtgaacagtgactgtctgacagcaagggatcctggtcgcctaaggagaagacacaggagtaatgagaagacacaggaggtagagcagcacttgctgactcagaagcattaacatgaaacgctggagtgcagggcacaataatggttgactgcagcctcaacctccagggctcaagggatccttccacctcagcctccccagtagttgggattacacagatatttcaagattcagcatcatttcagaccctgaaaaatccctgaaaattgaattctcaatagataatgcaactccacataatatctggattttgtaaatgcttgctaataaattattttacaacgtg

SEQ ID NO: 336384 - DNA, 379 bp, Homo sapiens
cagtttcagtgtcttcctgtggtctgtgaagaagagaaacttaacaacaagaagagggaaagggaaggtcgcctaaggagaagacacaggagtaatgagaagacacaggaggtagagcagcacttgctgactcagaagcattaacatgaaacgctggagtgcagggcacaataatggttgactgcagcctcaacctccagggctcaagggatccttccacctcagcctccccagtagttgggattacacagatatttcaagattcagcatcatttcagaccctgaaaaatccctgaaaattgaattctcaatagataatgcaactccacataatatctggattttgtaaatgcttgctaataaattattttacaacgtg

SEQ ID NO: 336385 - DNA, 255 bp, Homo sapiens
acacacacacacacacacacacacatacatttatctcttttcttcaaaaatttttgcatatcccctgcattcttattgtatagattaatatctaaataaatgttaatgaagtcaatgtgtagttttcacttttgaccaagtataatggtaatatttggaggaaggctcctgaacatcttattagtgatattaggggctctctttttcagggaatcaatcttagcaaccaagaagtaccaatggagacccatgact

SEQ ID NO: 336386 - DNA, 313 bp, Homo sapiens
catgtggcactgtgggaggagctttggaagcagaccccacacccttcccaggctctgggcctctgcacaggcaggactctctcaaggctgcccgacccacttccccacctggcacactcattgggatcttccaggacgcaacgcagagtcccctcttccaagaagccttctccaacccctagggacaagtgactcttcctcatccatatccttccatgctcccctaccccatatctccgtagatacgattccctgccattgggccagggggatgagaaaacttctgagtgcaagatggtcaccccaggccatg

SEQ ID NO: 336387 - DNA, 6042 bp, Homo sapiens
  misc_feature (845)..(845): n is a, c, g, or t
  misc_feature (2144)..(2144): n is a, c, g, or t
  misc_feature (2211)..(2211): n is a, c, g, or t
  misc_feature (2591)..(2591): n is a, c, g, or t
  misc_feature (2612)..(2612): n is a, c, g, or t
  misc_feature (2912)..(2912): n is a, c, g, or t
  misc_feature (2943)..(2943): n is a, c, g, or t
  misc_feature (3462)..(3462): n is a, c, g, or t
  misc_feature (3482)..(3482): n is a, c, g, or t
  misc_feature (3604)..(3604): n is a, c, g, or t
  misc_feature (3674)..(3674): n is a, c, g, or t
  misc_feature (3981)..(3981): n is a, c, g, or t
  misc_feature (4059)..(4059): n is a, c, g, or t
  misc_feature (4073)..(4073): n is a, c, g, or t
  misc_feature (4656)..(4656): n is a, c, g, or t
  misc_feature (5001)..(5001): n is a, c, g, or t
cagtcagttactcaatatttatggaacacttcctgtgccaggccctggatttctcagctgtaacacagataaccaatatgtgccttatccctcaaatagctgacccaacggggcccaaaccccattttcatggtcctacctgtcctaccaacttttttttttttttttgccaatttctggtttttcttcctctagatcctgcctgcagacatttatatttgaacctgtgttcttggttccagacaatgtgggttcccaccaaaacccacttgcaccgaactctcatgggcttattagtaactctgtgaaagagttggctgcagtgggtggggtgaggggtttctggacccccttcacacaccacttagccctctctgactggcccttctgttaccactcctccgctttgctctgaacaagtgaccctttccctggcccagcaaaccaagagggcgtgaacaagccagtcccgctacctggcgcttctcccagggagcattctcctccccttctctggccccttctgtatttttatggtgttttccccaggctgctaattaattagccttctttacaaaggcggtgctctcacctcttcttcagggttggctgtgttcatttgtttagaacattgttccgtctcataaattggttggttattagactttttgttggtttatgactactgcatggaaatttcaggatagtcaagcacatttagagaaatttggtgactggttgaaataattgttagggaaggatgcagatgttctgtgttctaagcaggcttgttaaccagattggaaattactgtttatatctcatttttgctgcataggagctcnttgagttagaatagtttccttttctacttctgctactgtcaaagcctcaagatgcaaaacacattcagtttagttgagcagctcctgcagtctgttcccagcaccagctatctgcaaagcgccatgttagaggtaagctgctaacttccatacagcctacaaaacccagatggccttccctatctcctggaagccttctctgactgctaccaccactttccccttccctagagttaatcttttcctttctgcaagtggcctgcgcatcctatttgggcatttgtttcatactgttcggtaattttttagcatcggcctctcttactagactgcgcactgaacctctgagtccagggactgtgtctccttcatgtttatatttccagcacccagtgggagactttaatagtcattagtaaagtactgaatgaatgaggaaaccttcaaagccagcttacatgagtgtttcatggggatttgttgaacagagatgccctgtctcagggtctcagtcccgtatctctctcctgtgctgttgcggcagcttcctgtctctctgctgctgctttgctcctgcagtctgttcccagcatgcagatcccgtcacccctcttcccggaaatctccagtgtcttccatcttacttcatggaaaagctagagcattcaattagaccccaaagatctgactcccagggccctcctgaaccccatcacttctgacccataatatacacactctaccaagctacccagaagcgcctgctccccctggaatgtactcccttgtcaaatcttctgatctagatgttcctctgcctagaatgttcttcccagatgcttgcatggctcacttctttacttcctcgtgtcttttcccagctgccaccatttcagtgatgccttatcaggacatcatctctgccaacagtctcacttcattcttttctagaatacttaccaccttttaatgtactatatatattgacttatccattgtttttttgtctccctcgctgaatgcaagccctatgaaggcagggatttgtggttcctctggttcatcatcctttccctcacactccagggactagattgcatgtcgtcatggtgacagccaacatgcagatggtgtttttgtgtcaggcgcttttctgagcatgttatacattatgattaataaacggaggaggtaagagtccaccaggcagtctgagctctgagcccttatgcttttctgcctagtagcaagtatttgttcaaagaatgaaggaatgagtacttatgataaggagataangcaagttggcactgccttattagcctgtgttgcagttgaatgaaacagaggattcccagccttctcngagcacccaatgggactggcacttatgggagagaagaagctatgacaggggcttccatttcagttgtgccctaaaagcagctgggccaaaaggtggatcttgtggatgtaggtgaattatcatatgtaatcagccaactcaacttttacctccagactcttgcagcaaagaatggtcaaccttggaacattatctttaacatctcaaagttctttcttatcagtcacctcattttcttctcacaggaattagataaggagggaaggacagatggcatcatcctcattttatgtgtgagagcaggcagagctgaagagacatctatgaagtcccacagctgggagccagaatcctaacccagatccccagctttctcctgncaccttcaggcctccctctgntcagtgtgatcatctttagactctccaggtggcagcaagctttgagaagttcctgctgctatttttactattcctgattctgttgacccccaaaacagactgctgagaggatgctagaccatgctcctggggagcaccagaaagggttcctggagctccagtgttcagctgcaggattgaactaagcacacctgttgagggggaccttgagaggggaggctgctgtagtttacaaagaaatgaacaaatagggcatatcagccctgcagtgcagctttaaggacatctcccatggtttgngccttgcggtgccatcctgccctgctggacntgaggtgcaaggtgtccattcatctagggctgccccagattctgcagatgtctccaatgcagtaccttggaagctctacggggcacaggcagctcttccaagaagggctaacaggtggaaaaggagcatttatggagcacctgccatttgccagcattctgctcagctccatgtcttactatctgttagcctcactctttgcagacaagcaggagatgagaccagactgggtaacacacccaaagcaccacagtggtggggcaaggctcccagtctgctccttctgacttgaagcacattccatcgccatatcactcatcacttcctccttgtcaaacaaagcaagactctgcactagcttcaggcttttgttttgttttttgacacagagtctcgctctgtcgcccaggctggagagcagtggcgccatctcggctcacggcaacctctgcctcccgggttcaagcaattctcctgtcttagcctcctgggtagctgggattacaggcgcgcgccacnatgcctagcaatttttttgnatttttagtagagatgggattttaccacattggtcaggctggtctcaaactcctccactcaggtgatccaaccaccttggcctcccaaagtgctgggattacaggcatgagccaccctgccnggcctctagcttcagtgttaacctttgtgctgcttcctgtaccccatgaggctgaacatgaataagaagncaagtttctaaagagtcttcaaactcagtaggtacagagatactgccctcagctgtttgtagatgtcatgtaagtagagatgttccacagttttcttgccagccatgaaagcctaaacaggagctttcagccttcgtgggtcttcattttcccagcctaatccaggactgggtcaagccaaatccaaggtgcagagagaaacattcccacttggcttcttctgatgtaaatgatgtgatctggtctagatttcccggttgacttatcttttctgttcagtcacatgatttggtgtatgtggattttnaaatctctttattataaaatttaaaggctgcagaagttatccagttgctcctaaagaattacaggttgagcgggctgncatggtggcttacncctgtaatcccacactttgggaggctgaggcaagcgaatcccctgaggctaggagttcgaggtcagcctggcaaacatggcgaaaccccgtctttactaaaaatacaaaaattagctgcgtgtgatggcatgtacctgtaaccccaggtactcaggagactgaggcaggagaatcacatgaacctggcagagggaggttgcagtgaaccaagatcatgccactgcactcctgcctgggtgacacagcgagactccgtctcaaaaaaaaaaaaaaaagatttacaggttgagtatccctaatctgaaaatccaaatgctccaaaatctgaaacttgctgagcaccaacatgacactaccatggaaaatttcacacataaaagtactttaactttgtgtaatgctcaaatgtatttaaaatatttttaaaaattacctttagcctccatgtttaagatatatatgaaacataaatgaattttatgttgagatttgggtctcatctcaaagatagcttattatatatgtaaatattccaaaatctgaaaaaatccaaacacttctcatcctaagcatttcagatangggatattcaacctatataaacaaagttgcttgcattagccaaccagaaaaacaaccaaaaaacactttaccttttccaatgcccatgcccccactcagctctgatcatcagtaactccattgatcactgtgtgctttcattcttcctgtctgatgacagctgtcccaatgggatgggcagagtgtcaaaggccagccagcaggtttcctgtcacctaagaaagcaacggccaccagtgatcactgtgcccccattcagggtctcacaggtctgtacagtcatgctgtctgccttagtagcagcattcagactcaagttacgttgcgacccatggcttaacaggngcctggattgtgatgaaaatcaccatgaatataaggagtcatttgagggtcttctgtctagttgtctgtctctggtggtgcccagggctgtatgggtcctggggcactctgcttacccactcacccactgtgcatcattttcagaagagtaagctgcatcctaatatccctcaataatccaatatgtttcttttcatctctgaattattagaccttcctggaattctatttgcagctgataggaatccaagttctaggtttcctgccaactcttcagtgaagcattttgctcattaaccaccaaaactcattcgggctggagtagtcaaatcccctcatcataggaacacatgagtggagggcaacagtgggtttgcctgccttgttggaatcaggatccttgatttaaggagactctaagagaagctagcaccaagtaacctagtagtaacctatagttgcctttctcagcaggcaatgcctttctcagcatttcctccttcaaggagatgggaagaagcaataaccctaagaaatcatcagtatcatcatcttcctttttctgatgaggaaactaaggcttcagactgttaggtattttgcccaaaggctcacatagctggtaaaagcaagaggcaggatgtgctctcagggccagctgcccacagagccttcggtgggttttgctttgctccttcttactgtcttttggctcattaaaagtaacacaaggccgggcgcggtggctcacacctgtaatcccggcactttgggaggttgaggtgggcagatcacctgaggtcaggagttcaagaccagcctggccaacatggcaaaacctcgtctctactaaaaatacaaaaattagctgggtgtgggggtgcacacctgtagttccagctactgaggaagctgaggcaggagaattgcgtgaatccaggaggcggaggtatcagggaaccgagatcgcaccgctgtactccagcctgggcgacagaacaagacttcgtctcaaaaatatatctatacaagcacaaggtt

SEQ ID NO: 336388 - DNA, 493 bp, Homo sapiens
  misc_feature (13)..(13): n is a, c, g, or t
tgtcacccaggcnggagtgcagtggcgcagtctcagctcaccgcaacatccaccccccagccccatgcaattctcctgcttcagcctcccaaagtgttgggattacaggcataaaccaccatggctggccagacttgctttttcttcttgcatgtctaatgagttcttgagttcagtacctgaactcagccctgttttcgtgttaattggctcctcccagaactctaggtctcatctctaaaaggttattttaggcttcccagtacatagatagagcatgctaagacctatagattcagcagttttgggccaacttctcagaacatgtggaaaaggcttttgttttagctcttggcctttggtggacttaccacccagaatcttaggggggtcctcgctgatgactttttgttgatgttgatgctattcctttctgtgtgttagttttccttctaacagtcaggtccctcaggtgcaggtctgttggagtttg

SEQ ID NO: 336389 - DNA, 491 bp, Homo sapiens
cctgggaggtagataataccaaccatattttatatataaggaaaatgaggctgaaatgttcagaagcattcaaaggtctcacaactaaatgttacaaggaatttgaacccaagtctctatggtaggtgctttttcttaagcagctttcctttcccatggccactggaaatacaattgacaatttagtgtgtggactccaaaaaccggcagagagaatgagaggtgttttttatgcatgtcctttaggtaaaggtataaaaaaaaattcttgtcaacaaatggcttgtttcttaattctgtttagttagccctgggttcaaacaggtaatggcctaatgtgggattaagaagttgcagaacctgttgaaaaaaaaataccaattctgactgaatgtgcaattaggccacaactatggaaaacatccatgtactcagagctaaaaaataactgtcaggtttgacaggaacctgagaattaagcttcccaaaga

SEQ ID NO: 336390 - DNA, 693 bp, Homo sapiens
atccagaaaataagtgcagaagcttggaaaaaatgatagtaagagaagacataagacaactgtttaaagattttattagcaaccaaagcaaaaaagctccagttttatttccagcaagatgcattgatatctgcagtcttccatcatatcccaaagcacttcatctgctcctcggatcaccctaatgggtccttatctcaccttccagtcagagaagcttctggtgcacagcacctctcgtgttgtgatggcttgctgtggtctctgaaaggcctgtgcctcagctggggaaaatggggcttatgtgaaagaggcataacagctccaatgtctcattttatttgaaccctccagttgccttgttttatgctgttacaccatctaatctaaagcaaagaatttatagtaaaattttaggctgggtgcggtggctcacgcctgtaatcccagcactttgggaggccgaggtgggtggatcatccaaggtcaggagttcaagaccagcctggccaacatggcaagaccctgtctctactaaaaatacaaaaattagctgggcgtggtggcaggcgcctgtaatcccagctactagggaggctgaggcagaagaattacttgaactcaggaggcggaggttgcggtgagccgagatcatgccattgcactccagcctgggcaacaagagcgaaactc

SEQ ID NO: 336391 - DNA, 795 bp, Homo sapiens
cttaactctgtgagaaataagatgtggcattgggaaaaataaactatgacacttggccaagagtagcattgaagggtcccctgtttgagttaaattagcttggattccagaattccatcataacatcatgtaccctcttagcccctcttcttgcagcacacatgctggatattgtttttttttccctccgattctaacaactaacccccctcctgacacgcctgctgcagtcacttgacaagcagggcctgaccttcctctacagcctttcagagctccctgcggcctgagaactaacagcccagttgcactgcttgcctcagggcagggtgagatttctggagttcctggagcaggattcctgagctcactctggcagctcacccggggaggctctgtcttctccttggacctggaggaaggcaggacttggggcagctccaaactctgagcctggggtggccttcccctggtctttggcttatttacagagctggtgggcatgcgggccttgacacccaccacatctcatgatctgcccactcacctctcagggctcctcttgggtgcaactgcgtgtgctgaggagaatcacaggagccggagcaagaacacatgggcttggcaggagcctgctttgggaccgagagacgcggttttctgtatcttagaacttaggctctgagatccccggaaatctggaaaaagtccccgatgttgctggtcttttctggcagagctattcattgcctttagcctcctcttttgtccttatattaaaagacagcagactta

SEQ ID NO: 336392 - DNA, 445 bp, Homo sapiens
  misc_feature (420)..(420): n is a, c, g, or t
cacttgggaaccagctttatttctgattttttttttttgtcagagtataaaaaagtgagtgcagcaaaacaaggccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaagtacaggtcgtgcagaaaaccntcgtgccgattttttggcctcgagg

SEQ ID NO: 336393 - DNA, 3939 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcataaaaacaatcaaataggatcatgtttattgtcatgtgtttcctggtttctgacctgtgtgcacacccctgtgtgtttataatttttaaattgaattttatatggggtttttatttgctaaaaaccaggctgttgaa

SEQ ID NO: 336394 - DNA, 3470 bp, Homo sapiens
  misc_feature (5)..(6): n is a, c, g, or t
  misc_feature (25)..(25): n is a, c, g, or t
aaagnncgcgggcgaacgaaactanggctaggtacgaggctgggtgttgaagctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336395 - DNA, 4264 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcataaaaacaatcaaatcaaaaacacagcaaacacaacaaaaaaaaaaaaagagcaaaaaaagagagaagaaagaaaaaaacaaaaagaaagaaaacgagaagaaaaaaaaaaaagaaaaaagaaggaggcacgacacaaacaaaaccacacggaggaacagcaaaataagagaaagataataggagagaagcaaagaggagagagaaaaaaaagacgagcaggacaagcaaaaggaacgaggaaaacaaagagagattgagaggaacgccacagtgaggaggacataaagacaacaacaaaagagagaaggcagtgaaaaaaacagagctactacacaagcaaagtcgaaacagacaagaagtgaacaaccagagactgaaagggagacagagaacgcaggggggcgaagggcaagaggtaagaaggagagaggaagcacaagaagagaaggaaaaaaaagat

SEQ ID NO: 336396 - DNA, 3885 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcataaaaacaatcaaataggatcatgtttattgtcatgtgtttcctggtttctgacctgtgtgcacacccctgtgtgtttataatttttaaattgaattttatatggggtttttatttgctaaaaaccaggctgttgaa

SEQ ID NO: 336397 - DNA, 4177 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttctatgtgtgttttaataagtggtgatgctcccattataggaatccattatttacctaattttctaatggaggaagagagaagagataattaccactttctgtggaatactcaacttacaaccaaataatagcaatctaggaaatttagaaacagtaaaggtttttggtttatatttcatgtatagtgctgctgttccaaccttacaaagtaaagctgtctgcttcccaaattccaaaaattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcataaaaacaatcaaataggatcatgtttattgtcatgtgtttcctggtttctgacctgtgtgcacacccctgtgtgtttataatttttaaattgaattttatatggggtttttatttgctaaaaaccaggctgttgaa

SEQ ID NO: 336398 - DNA, 3851 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaacagagtcccccaaatacattcagaaacaaatatcttataattacagtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336399 - DNA, 3833 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaacagagtcccccaaatacattcagaaacaaatatcttataattacagtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336400 - DNA, 3456 bp, Homo sapiens
  misc_feature (5)..(6): n is a, c, g, or t
  misc_feature (25)..(25): n is a, c, g, or t
aaagnncgcgggcgaacgaaactanggctaggtacgaggctgggtgttgaagaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336401 - DNA, 3445 bp, Homo sapiens
taactaggctagtacgaggcctccgggttaatcggacgaggaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336402 - DNA, 1991 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagt

SEQ ID NO: 336403 - DNA, 3292 bp, Homo sapiens
  misc_feature (26)..(26): n is a, c, g, or t
  misc_feature (31)..(31): n is a, c, g, or t
tgtgatagtgttctagaggatcccanactcngcacccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336404 - DNA, 3815 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccccgccccggtttgggggggggtcccccgggggcccccttcaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336405 - DNA, 1665 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggtaaaattaagttttgtcgtgtttgaaaatgttcagatgtgacttgaattgtatttataatttttgttttaaaatttcacatgggttatttgtctgttaaagctttacataggatcatttggggcagataatttgctttataaggaaaataaactgtattatcacatattctaagaaatttagtcctttgatcaatttgtaattatgttttatgtggtagagttactttttcctaaaaagctgt

SEQ ID NO: 336406 - DNA, 3054 bp, Homo sapiens
caatcgagctcggtcccggattgacgccacgtggcgcttaagacagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336407 - DNA, 3011 bp, Homo sapiens
cacttgggaaccagctttatttctgattttttttttttgtcagagtataaaaaagtgagtgcagcaaaacaaggccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336408 - DNA, 2897 bp, Homo sapiens
aaactataggtcggtacgaggctggtgctgatttagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336409 - DNA, 2862 bp, Homo sapiens
ctggttgtcaatgaggatatttattggggtttcatgagtgcagagagccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336410 - DNA, 1335 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagttccgctgaagaggacacttcaaaacaaaagaaacgaaaatatcagaacaaagaaaagaaaaaagaaacgcagagtaaatccaaacaaggggagcataacaaaaaggaaaaaaaaagaaatgaaagatt

SEQ ID NO: 336411 - DNA, 2866 bp, Homo sapiens
tatcgtgcagatcgtgcagaacatcagctctccgccttctggaaggagaacacgtaaaactacagaatatcagttaagcaccctggagagagagagatataaagaaaatcaggaagattcaaacagtcgtgctacaagtagcggatctcacaactggggaactgtcaaagacgaattaacagagtcccccaaatacattcagaaacaaatatcttataattacagtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336412 - DNA, 2671 bp, Homo sapiens
gtgggttgaccgtggcttgtgggttgaccgtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336413 - DNA, 1511 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaacgttggtattctgattttcttaaaaattctatacctaactagaggttaatccatacctctgtcaaattttacttgtctctgagataagaatgaatgctctcttctgagagttactatattacaagataatgtcttatgggatgggtttgggttatagtatattgaatgaccggttttttaatatttcgatatatttgttactcattttttcccccccatatgtatttgtagcttttcctgaaaccccacaataaggttatttgggtattctgattatcttagtgtccttaatagttcctattctagcttttgactttgttgtcattacaaaatttgataagctagtaaagcttcattttataatt

SEQ ID NO: 336414 - DNA, 2985 bp, Homo sapiens
tgtgtagtgtttcacttgaatttgtagctctccaatttgtgtagaaaaacgtagtggttgtgtattaacagaaaatgcttctgagaagtttatatctagtaaggtctttaccctagttgtagttggaagagtgtagaacagagtttttctttctgagtgttctttttaacttcagtgttagtgctagtagtaaccttatatgtcatctctccagaggtcttcatcaaggattcacatggcagtcctgatctgaagggcatatttaaaatgtacttgtccagatttcactgctaaagattatgattcagtaggtctaggatgggcttcagccgtttgggttgattgtgatagcatacatgtctttagttgaggactgctggtattacctgcaattttgagatagagaaaagtgcaggaaaatcttcctccaggatcactaaagctgagccctagcttgttacctgtggaggcattgagacatttgttcacagaaagtacagtttggatttttggttttttttagaagaaagctcattatttagaaattttgcaatgttacttttctactaataacacaatcatcttcacttatatttttaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336415 - DNA, 1710 bp, Homo sapiens
gcgggccctactactactaaatttcccggccgtcggcaatatttccatttttggggaaaatattaaaactaagttaaaatacatatagttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336416 - DNA, 1049 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggacgcagacgcgcctataaccgattccacacactgcgccgtactatgatcgagctcgta

SEQ ID NO: 336417 - DNA, 744 bp, Homo sapiens
ggctgcaggaattcggcacgagtattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcataaaaacaatcaaataggatcatgtttattgtcatgtgtttcctggtttctgacctgtgtgcacacccctgtgtgtttataatttttaaattgaattttatatggggtttttatttgctaaaaaccaggctgttgaa

SEQ ID NO: 336418 - DNA, 587 bp, Homo sapiens
aatttctagaactaaagagtattatgttaactcagttttgttagttctttttcacattacagtggcctgaagcacgaggacaaacgtggaggtagcggatctcacaactggggaactgtcaaagacgaattaacgttggtattctgattttcttaaaaattctatacctaactagaggttaatccatacctctgtcaaattttacttgtctctgagataagaatgaatgctctcttctgagagttactatattacaagataatgtcttatgggatgggtttgggttatagtatattgaatgaccggttttttaatatttcgatatatttgttactcattttttcccccccatatgtatttgtagcttttcctgaaaccccacaataaggttatttgggtattctgattatcttagtgtccttaatagttcctattctagcttttgactttgttgtcattacaaaatttgataagctagtaaagcttcattttataattaactgccttgttctgttactttttaagtatgaagtatatgaactaactagtttatattgtttacttttctgacgtcgactggtttagta

SEQ ID NO: 336419 - DNA, 450 bp, Homo sapiens
ccaggttcaagcgattctcctgcctcagcctcttgagtagtgggatcacaggtgcctgccaccacacccagctaattgtttatatttttagtacagacaggatttcaccatgttggccaggctggtctcaaactcctgacctcaggtgatccacccaccttggcctcccaaagcgctgggattacaggtgtgagccactgtgcctggccaacagtaagatttttttagagttctgtcttaatgtagacactagctaacaatgtaattttgaagaactgagaactgtggttaattttggtttttctttttcagtcaagtgcttctgctcctgatgtggatgacccagaggcattcccagctctggcttaactggatgccataagacaaccctggttcctttgtgaacccttctgttcaaagcttttgcatgcttaaggattccaaacgact

SEQ ID NO: 336420 - DNA, 3788 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336421 - DNA, 3806 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336422 - DNA, 3851 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcaaaaaaaaaagtcgacgcggcccgggaatttaagagaagtggtagtcgacccggggaatttccg

SEQ ID NO: 336423 - DNA, 3753 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctca

SEQ ID NO: 336424 - DNA, 3885 bp, Homo sapiens
agttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacagaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcataaaaacaatcaaataggatcatgtttattgtcatgtgtttcctggtttctgacctgtgtgcacacccctgtgtgtttataatttttaaattgaattttatatggggtttttatttgctaaaaaccaggctgttgaa
